United States Patent 7,491,813 (PROMOTER POLYNUCLEOTIDES IDENTIFIED FROM ZEA MAYS FOR USE IN PLANTS) - sequence listing, part 5

SEQ ID NO: 11801 - DNA, 94 bp, Zea mays
agtaagtaacactatgtgtgatgttaatatttggctccctacttctgtgcctgatgcttttcccccatcgtttttaaactgtaggagtattcct

SEQ ID NO: 11802 - DNA, 85 bp, Zea mays
gacacaaatagatagttcattatagttttttcttttatttacaaatggtttggtgataagttattttgaggacagaagatgctac

SEQ ID NO: 11803 - DNA, 1500 bp, Zea mays
agcaagcactgatctaattttgttgtcttagtacaattttcttgcagctatgggctggtatgtgttataacaagataaactccagtgctccacatgttggctaaatctagcagaacagaaggcgatattatttttgcaggctgatgtatttgtacgatgaatatatcactatcatggtatttcagaactcagattcatcatggatgtagatcttggttatttatgtaaactagattgtttgctgtatggtagtaatctagcacttagtagtaccgaaacttccctagaaccatgctttggtccacaatgttggatttatttctctttctcttgtctaggttctattactactacatgtgtgataatattttaaaagtgttagtctcaaagataccgatttatagagttgtcccttaagatgtgcatagaaattttgaatgcttgtaggagatatgtacttggacttctaaggtcaagataccgtgtaaaggataatgtcatgtgagtgtgaacattactcaagtgatatttaggtgtaggtcatctataattcggacttggcgcatataaatcaaatgacaccattagtagattttagatgtcacttaaaaattttaatatcatttgttaggaattttgaagacctatgtgtcatgctcataatcatttttaaaccatataggtttgctaatcctaccatatgattatcctagttgcatgattcaatatgatgatccacaagtttaatatcatttgagccaaatccaagttattatggcaaaattctaatattctcatagtttaatccgtacctgcttctactacttctacaatgttttgtctctatggattacaactgcataagtccgaacaactgactttaatccgaagcgaacagactgtttgtctttaaccaaactatgttaaaataattataaaaaatagagagctaaatagtatggtataaaagtgtaatttattgtgaatttaatgatatttatttggtatcttaagtattactgataatttttataaatctggataactttaaagatggttggatttaaaaacaaaaacagaattttatatcttttttgaatgggggcagtaggacaattatacagtagtaccgcagaccgcggtgatgacagttgacaaacataactgatccttctgacatgtgaccgtggtgtttgctgtgcagaattctgctgtacgttctacgctacgctgcgttgggttctggttctggatacgcagctggggtcatccaaatgtccgtgcaatcctgtcaggcagcacgttgggcgagcagaccgaagatgatgctgcggctgccggcgcgctgcggaatcccggaaagacaattaaataccaccggcaccacccttcaaaccgcgtagaaacaccgcgcgaaacaaacccgatcgggagccaccgcccccgccactccaccgcacccacacgcagcttgtgcgcgcgcggcctcctcgactcgac

SEQ ID NO: 11804 - DNA, 1040 bp, Zea mays
ggttcaccaaatcagccctaagagtggctgcactaatgactatctcgagcagttttagtttactatacgtatacacatattcaaactgctctctagtaatatataataaaaataatgtttttggttatcatatgagtgaactgttgtacattgcatccatatatatagttaaaaaacatagttttgtattatacattacactgtttgtagagtgtaatttgaatattaatatatgtatgataagctcctagagggcacgatggaccctctctctctcggccgtagcaaccaccacggtgacgcgacctcagccagcccatccccacgaccaccatagcgttgagataaaaaaaaaattctaaatcacaattgtaaattttattaaaatattgcctaatattggaaaattttctaaatcacacaaaagaatcatctaatcaatatattattttagtaaactaaataaaaaaattaaataaataatacaaactacataattaaattaataactacttatccaagaacaattgctaattcactaaagcatctaagcaatatatactaatcgaggcattgtttactaatctaagcaatagtatctaataaactgattaccttaatctctaataaactcaattgaatcactaatttatctaaacaattaatcatctaattacatttatcaactaattttcgccatgtccgacataaattagcactttacaaattaaaatgatacgttaacgtttaaaaactaaggggcggccggggttggcgcggcctgcgcaggggctcggtggcggtgcgatctagcggcgcgggcgggcctgggcggtagtgccatgacggtgcacggggyggtgggggccgtgggggcgtggggcaaggcggtggcacacccgatgctactggagggtgtggtgtgaccgtgtgagacggcgctgcatctccagtagaattagcagccagcacggacagtctcaaggttgtattcatgccctgtgggtgacatatatttgcatcggcacccgtaatctaac

SEQ ID NO: 11805 - DNA, 1500 bp, Zea mays
gggaaaaaatatgttttgttagtaaaaacataggaaaaatatgaaatctgttgtttgacatttttcaaataacaagacagtagaaagtgcctttttggcattaaactttggaaaaatcacaactaaataaccatcacttagcattctatgatttttggcacagaagcttgtttttactgttggatgccaacaaaaataacccttaggacagaacccacccctagttaagagttgtagtgcaaagtggctcatttgcccaacgtttgttatatttgtccaaggcatagtatttttattctgaacctcaaattcctagaatagactatagtaaccaatggcaacacactgtaatttttacagaatttttggaaaaaagttaaaccactgttgtagttcaaacccacactagaattcataaatagaaaataaagaaggggaaaatgatggaaattagtgtcaccctaaaaccctttgtgaattgtccactgaattatataagggaaatacaaatccactatgctcatccttaccaaaacctaaacctagaatgataagcataaactactaaaagccacgtatgaccaagaaaaccctaagttactaactaacttagtttctcttcctttggcacaatgttattaaatcctgcataatcatgacatacatattcattgcatttcgatagactgtaacctcgctgacggagaatacgtcctcgtgccggtgcaaggagctgcttaggaggttgttgggggccttcggctcccgaaggtcctcaaaaacgtaatttgactatgttttccaagagaaatatgtgaacagctaccttcgaagacagattgcgagtatacaagagcatggtaaagacgaaggttgactgggacggcgatcacgacgaaggataagacgatcacgaagctatgtgcagaagagcttcggcataacggcgggaaagggaaaccgacttaaagatgaaaagccaaattagacctcgaagaattattatagaattattgataaatgtaaagggcattaatgtaattttgcatgggctgcgacccgtgcctataaataggtgaacagtattcacgtactgttcacgctgacttggcattcacttttgtgtcacacctgtattcctattccttcaagccgaaggtacatttgtaatttattattgtttgcacaagtaatataaatggaaatagactaatagtaatgtttacagaaattatgttactttctgtactttgtatgaatgttttccatcttttattatgatcgtgaaggtatgtccttcatgaccttcgtcccaaattcattatgtccgaaggraaataatgatccgaaggacgaagggctttgatatttaacattttatgttgccttgttcttgattcatagcatttgagaacaagtctccaacattggcgcccaccttcggtgaactcacttccattttttgagtcttgaacaccttcggcaagcatcaccttcgtc

SEQ ID NO: 11806 - DNA, 219 bp, Zea mays
ggttagacacaaacaatttttttgtcctgttatgcagatgttaaaatattattactgctaactattctatttgattttatacagtttcgtagccgttcagaaacgtgttacgtcattgctccagaacggcctgcttctgycgttttcaacatatatgtgccacgtatcaakaatttgattggcaacaagttgcaatgtttgccctcccagcagcgtcca

SEQ ID NO: 11807 - DNA, 1330 bp, Zea mays
cacgagatttttcttgtgaatggagtcactgatgccttgagcatccctccccagggtacactctgttgttagtatttatgcatattttactgttgtttactgcttatatgagtagtgatatacatatgcacatacatatcatcacatacatcactgtgattttctggattaaattaaaactgaaaatgcttattttctaacaatatatatccaatgaataccacatgtacgttgtgtgttcaaacactgagaatcagagtatgagacctcaggaggcgatactaattaggagggaatatggagcgcgaaagaaggggagatgacatgtaaaaaagataatccaaggtcagtttagttaaatgggccgctgatttcgtgcaaggcggcgatgaattaagattcagtccaggaagcaatgcagggtcagttatcgatggttagtttcaccaaactccgacgatagtgtactagagtagactaccagtgacgaacgttatagatttctccgccctctacgtacctaggtggatggcacacaaccttatataaaagaaaacgtaaataagaatgtgcttggttgaggagcggatgggaataaaacggcttcattctttttttttatgtttggttaccataaaggagagcggagcggctcctgatgtccataaatagcaaatatttaggatactctcgctccacaaaacgactggatacgaacgcgagcgctctcatccctctcctccactccaccacatacactagctaataacaactgtatatcggtccattgaggccatatcattgtagggcccgggccacccatggcatgataacacggcgtcatttgatagcgatattaccttatttcctttagcttgatcatgcacggcgacgtagggcggcgctgtttcattaatttactatgtacgctactagctggatttcgttggagtttggtggaacgaagcattcatgcattgcatcatcggatctgatatactagctgcatattacttacaggactgaacatatgttcatcgtcgcctgcttgcacgaaatcagcaattccgcgccatttcattaaccctgatcgagctgggatctttttaagagcccagcaagcttcagttacctagctacgtgactgatagtaaataaatttattgcagttgccccatctatataaatagcactgtctcattactacatttcgcatctctatcttgtatacgtaccgtcgtcgatcaatccgacgatctcaatctcaattcttctcaatctataacaaggaaacgatatatcagagtcacgaactcacgatcgactcgca

SEQ ID NO: 11808 - DNA, 1500 bp, Zea mays
tgatttttgaaccaattggaaactaaaagctaaattacattttttctatatccatttttctcttactaatctcgatgacgagattatttttaagggggtaaaatttgtaataccaaaatcctattctgagatttataaaatattcctaaaaagagtaagaattaaaatgtctatcgatatggattcctcacttttaaagttattctctcctaaaaaatatttggcaatacttaaatgtcattagtcaaacatagaaccaaactttttgaaactggaaatttaaattgaattccggaaaagaaaacataataatagaaaaaggccctcaatctagttgctaaaagtggaatatttctctcatgaactatataattaggaatactttaaaaaatgtttgaatcaaaataaaccctggtgaaagatatgcgttaagttcctccaaagtaaataatcgatggatattcaattttgaagaaatttacaaatttatcacacattcaaaatactattttcccataaggaataatatatagtcatacgtgaaacattccctagtaaawtaataaagtaattaataaatacatttaaaatatttgcatcccatgctggaccactatttgtgcatttattttgaagtttgaaatttgaatttgttggagaactaaaatttgaaaaaaaataaaaaagatgaaaacactacagctcctgggtcgaaaccacacaacccagattgctccacaccagtgtatgcccaccatgacccacgccctacattcccctgacytttggggcctctttgtcatccaataaattaatcacatgcgcgtggggactagggtttctatcacatgggaccagcaatccaggtgcgtcgaccactgcatgctcgaaaacactcatttgagactacctggtggggcccaatagccagcatcgaccctagctaaagccaaacgaactcctcagtgaatctcgcgtgcgatattccttccataaccgccatcgtatttttctccgccccggctggtttcgcttgaccttggatgctcggatatataaatcctgactcccgagcgagtagcgatggccacgcctgcgcctgcgtcttctgtggcggcgcccctacctcacgaacccgttaggcaatctggtcgaccttgcctcctcgactagctatctactcgctagcgtctattggccagtaggcgcccagctcccaagcggtcgcagtgcccctgcttctgcctttgcccgtttggcccctgtgctgcacagcgagccagacaaagaatatagtttgaaagatgatgaaccagcacagagaggaggatgccttgagaggtcaagcagtcaaaaaaccagatggcgatatgggacaagaccctggaaatgtgattcttgctgcagaaggcatttctacttccaacaagttgccccaggaacccatcggatcaaggttttgcaaacatgataagcagatagaagcaaactttgagcagt

SEQ ID NO: 11809 - DNA, 480 bp, Zea mays
gcttctggagatccggatacacagtctgcggattcacatgagcaaacgaacagctggaggctaacccatgctcgtatacttattaggctgtccagatcgtgcaaaactagagaactgctggagaccgctcacacactgaatacgcgtttatacgtcagggagcggacaagcgcgaggagagaaaaaactatcacatcacaaaatgaaaacgggtcaaagtaaccatgggcttgctgccctcgccgccgcgcaaaaaacaccccgcgggccgtgtccccacccgtacccgaattccatttcttcctcccctttttcctttccacgccttcccaccactcccagacagaccccctttcccctccctcctcggcctcctcgaccactccgacgcccacagcgcctccggcgagctccacctctccaccggcggcagcgaggggcgagggggctaatactgtaggcggaggaggagccgagccg

SEQ ID NO: 11810 - DNA, 1500 bp, Zea mays
tgcatagaaaaaaattcctgcctgactgaaaacaagtccgagtgtgtcgtcgagtgtctgacgagctagggccgggccgccaggccatgtgatgaactaattagataggcagaggcctggttactgtcaagctaatgaccgggttatcaccccacccatggtgtctccgtctctaagcacattaaagtacctgcagttttctgctgcaactgcctcctcgttgatatatactgtagtttatcctgatgtcaaatctggcagtgagattcttcatcgctctgtgcacaagtaccgatcggagtcactgagtcaggattccgggagagagcttggccaaggcgtttacctcgaaacccctaaaccaaccggctgcctgcttgcatttgctgtctacttcacttgaccagcaggttaatcaaacacactgtaatcctgccaggtcaaactgaaccggcctgggcctagcatctagcagaaagggaatctcgagaatcgatcatcatcattgcgagcgtaatacgtacaattcctttcgttccagttgacttgcctaaaagaccgaaacaaataatcgatggagaagctactgtatcgctactccactgggtagagctggggtagctgcaagtgacagtgtactgtgcagctaacgccccctacggcacgctgcatgggtggggtggggttcagttccgtcatctgcaaaatggccagcagttggcggagctttattgttagtagatgcgttagctgggcatctacttttcatcaatcattaataggttactccaactagctactagtagctagtactgtctcctaattaaccatgtcctccccaccctcctttagctactcggcataaacgcgagcaggttaattacttcaaggggcatgagcatgacaggtgagaggacacctgtctcgcagcggtggcgggaccggcgggtgacgacacagtaatctgactgcaactaactgaactgccatgcatccttttgctgcactgaggcacgagaggagtgaacgcaagaatatttccggtgcaagtacaaattaaaagctatgggctttatgtgaacgtcagtcatgactcatgaaactacgatatcctgaatgaaacacatatattgtacagaaggattcggatcaagatcacccaaaattctaccaagccgctagcgaaaaaaaaggagaagctagacacatacatgtgtgtgtgtcggctgtctgtctgtctactaccgtgtgaatgaatgatcaagtgtcgccgcgttgcctcgtgcaggcgctggcgcgatcgtccttggccggcgcccacggcaggccgtcgtcggcgcacagggcgcccggcagccgcttgctgccgcgccactgccagatcttggacacgggagaagctgtcgccgcgcgcgaacaccttcttgccctgatgctgctgccggtcgtcgccgtcgacgccgctcgaggcggctacggcgggcgctggtgccgtgccgc

SEQ ID NO: 11811 - DNA, 1500 bp, Zea mays
cacaattaattcgtatatagtgtcgggttgggtcaggttggtctgtgccttcctgtggaacgcgtcgtcgagtcgttttttttttgctttgggtcgtgttttcggttaggtcgtgttttggataaaaaatcatggattgtatctatgccatggattgttgcgggccaaaacgtatggtctattcccgcccatcatattgtttgggttaggtttttttggcgagctagaccagggcgatcgagtcgaggggcccatacttaagtacagtaaaaaaattatctatagttatgatattcgaacttgtgttaccaataatttatttctatgtttttttattaattcctataacaacatgagtgagtctaaaaaatgaaactagtttgggaaacaaatgacacataggtactataacgacatgccagctaaaggggcagctaaaagcaagatagctagtgtatccaacagggaagacatagagagcaaccattttagataagatgacaaaaaaggttaaataaaagctagcaaggggtatctattttcatacatgtctctatgatagagaagtaccaccatccaccaacccaataccagtactatttgacataaatatagatcgtaaaatggcttctctcctgaatacactaacaagataaccaactaaactattgatggcagccacgatgtttggttccactcaaataaagtttagtcctattacatcgatgatagttgagtcttacatatagtctaattataaaaataattacataaataaagactaaaagacgaaataaatatattaatcctaactaagactatatgtaatacttatacttgatatccaaatatttgatttaacacaatctaaacttttgtctgttgaactaaatacttcctaaatgtcgctaaaatgacttctttctaatggaggccaaggcttgaattcagagtcgtccttgaaatttcgcgagtattatcaaccgcttaagartatgtacaattctaaaacggtggttcggtttttcaactacaaaagacagctaagagactatatgatataattctgatccactaaatcataaatacaattaaaaacattatgtataaagagtcatataaagagagtccatcttttttttcacttataaactcttaaaaccccctcaaaagcgtgtacatcccctagctatgcactattgcactctgccaagtctgcaggaggatgaaagcgaaacacaattttctccatccagcccccttaagatctaggaaatagcgataccgggctccgtcgaggcctttaaatgccggcacagatgttggccggagcaggacgccacgaggcgaacaaccaactgcttccttccgcgccgccgccgcctacaacgaccacttcacgtgacttacctcttctccgcctcaagtgttcacggctccatcctctctagagtctaagcccatctcgcgaagccgctaacgccgaaaacgaccctacat

SEQ ID NO: 11812 - DNA, 64 bp, Zea mays
ccgcccgccccctgatctagatctgagcctcccgtgaccgaggccgcgggtagacaggcatacg

SEQ ID NO: 11813 - DNA, 107 bp, Zea mays
agtctccagaagaaaagcgcagtactctgatcgacgtcttcttatctgattccacaggttcacgagctccatcgcttattcgcttatacaggatccagaagctcctg

SEQ ID NO: 11814 - DNA, 374 bp, Zea mays
tgagattatatatgcttttattcccttatcgaagaatgcgggaggcaggaggccggcgtgttattcgtctcccgactcccctactccaaagtccaaacagggcgatctcgactcctgaaatcccagttcccaagcggaacaaaaacggcgttcgaaggaacaacgggaagaaagaaaaccgccccccacgtacacgctcccacctcgcacgcccaccgcccccaccgcacttggcctcgccaaactttcccctcggcctccgcccagtcccgcacttccaccaccgcacctcgcagatgccccagtaggctccaaaaatccaaagccgtcccttcccaaccctcccttcgatccctggggcggcggccgggacc

SEQ ID NO: 11815 - DNA, 422 bp, Zea mays
ctcgatttagcgatacaggaaaaagtttgaatttgtctaggcagcggttaccagtcgtgggtgtttacccatcttgtagccgcagctgcctttctggctttcttggcccctcaaaatcattcaaccaatcccactaccaccctcaccgtgtacccagttcgtgcgcgatcagctgctacccagcgctctgggatcgggaaaaggaggctcttttgtggttcctaagggcgaatctcgtggcgattcggtcagatttggtgagtactcgggttcttgcgcgggtcaaagtgggttcttcgggcggattccttctcaaggatcgctgggaaggtgggatcttggcgctgattcgtttggtcttgcgctgcaggatttagggtttaggaggcggtgctggtgatcggtttgtgccgccgggagag

SEQ ID NO: 11816 - DNA, 301 bp, Zea mays
aatttgctaagaatgctttgtatagattcttagctaaccgaacgtccatcgtcgtccatcgtcggacggtggcttatcatggtcaaagagacgtcacttttttaccatggaactataaaatctgatgctttacatagtagataagccacatgatagagaaatagacggctgaggttcaccgagccgccgcttcggttctcctctaaaaccctagaaactaactcccacctcccggttcccgccgtcctcgctcgccccccattctccggccctccccaccgccaccattttccccggcgac

SEQ ID NO: 11817 - DNA, 1237 bp, Zea mays
ctcatagcatttgagaacaagtctccaacaagaaggttgttaaaatatggattattttggattttatagttactatgcacctggttacaaaaatacgtctatatatatatatatatatatatatatatatatatatatatatatatatatatatatataagtcgtatatgttaaaagacaaaacctctataaagaagaataagagagtaatatttataatatataataagtactaagatatttttatagtaaatatttatagtaaacttaaacatatcaacttatagagaaaaaagtctttacatcacaacatggacaattataccgcacacacagacaactgcctattgatcccagggcacgtgaacctgcacttagttaggacatgtacaattttattagatgctttttaaagagtctttagagacttaagtaaaaaaataaagaggcaaactcttcacgtatcttcacaatttttttatatttattgtcttttaattatatttatgatccagaggtttaaaactatggtatagtcacttagcatcgtgttgtattagaaaatcgttgtagtgtctctaggatgtacctgccctcatctccttcagtcggtgccgtgcgccactgttttcccactggcacgctgctgatccgagaagacgcgcgatggatgtaaactgccttcctgcagtccgcaaccaaccacgcatggaaacgcaagccagtctcgtgtcgtctcgtctcggcagccccagcaccgcccttcccctgtctcgcgaggcgatgtctcgcgcgcacgtcgccctcacaaccggacgccagctcacgaatatccatccgatttaatcccagcccttttcgattccgccgcactcgacctatcatataagtacgtgcagatatcaataagcttacccacttatcaataaggacatgtgcttctcacagataagccagtgctgggtggcgtggggagagagaaaagggcgagaggtctgcaacgcatcgaagaaagcgagaccatagcttctctctctcccccaaccttctcttccacatctccgcttctctctcgcctccgcttcgcttcgcgagagacgggccgacgacggaaccctaggattcgcgcccgcctgagcggccaagccaccaggaccgcgccctccggacccgggggcgccagacaagctccggggcgcgcggatcgaccactggccggcttaccgccgccgctgcc

SEQ ID NO: 11818 - DNA, 183 bp, Zea mays
tgcatgcctgcagaagcttcctagggttttttaggcgtcgcagataaaagatcccctcactgcattccctctgagcgccgccactccctgacatcgagaccggctgcccgaccccggtccggcgatccctctgcacccctttctttgcgctgccagccccaatctctcgcatccctgtcaacc

SEQ ID NO: 11819 - DNA, 772 bp, Zea mays
gatagtgacgtggatggcttgaacatgcgccattgctccggcgtttaatatataatactcyctccatttttttagttgtcgctggatagtttaattttgtattattcggcgacaactaaaacgaaatgaagggagtagatagaaaatagaaataaaaactgctttgtcatgcaggccggaaaagaaatgtcatggtttcatgtcttgtgtgtttgttcgagtttggagaacacaacaacaacaatgtatatgttcatcttgaagattgaagtttgctagctatatccatatccatgcattttttttcgaataataccatgcatggttgcctggaaactaaatacaagttcaagcgggggaaaaataagcgaaatggagggtttctgtgacgcatctcttccctgtgcgtttctctctccaaaacaaccatggcgtgacttgtagcaccgaaacagcaaggggcctgatgaggcgtcgcccagagtggcagagccatgctactagcggacaagcaacacgcagttttaataccaacggacacgatcgagagcactctctctctctcttccccctccggcctgcctttttaaccgccccagcagcagcggcctccctccactcggtctcacactccgaccctcagtcctcactcaaccactgcccgccagctagctccagcagctagatcaggtcgaccgtcctcccgatccacccccgtgctccgatccaccacacgagctggctagctagccagagcggcggcacgcaggag

SEQ ID NO: 11820 - DNA, 302 bp, Zea mays
cgctggaactttacgtagtaaaacaaaacataacaacacaggtaaggtgagcacagctaggagtttcgtactagatcgatcggtagatatggcgagcatcggcgtacgggattgccgagccgtgcttcggccgaattggtggatctggtattgcgatacttgatcttcttcttcctccccctcgctattattcttgtccttctgcatctcataggtagaccttttctttctgtgagatactatctcatgaatggagtttgtctctatacccctgcgtgcaggtgccctgaagtttcggtacg

SEQ ID NO: 11821 - DNA, 770 bp, Zea mays
acgaaacaaataggtcatatctgtcattacacacacatatatattctgacccatggtatttccttttcagaaatagttatgtcccttgttttattgatttgccaatctggtgtatgttcgtcgtgaggcaaacgtgagcgctgtgagggcgtcaaatcctcccgcgcgcgttgcaagggtcctaaatataaacttaattaggtttaataaatttgtctcgtctttttaattttatagtttctatatttaatactcgtaattactatttaaacattcggtgtgacataaattaaattttagttaggtggaaccaaacagagaattgaggggggttgcagtgaattaggagaggattttgacatatagggcatttgtagatttaagacaaacgaacatgagtcatgggcagccaatgaacatgattccatacgtattgttggccgacgaaaggaaaataagtatactcggacgtatttgcgtaggagcatagcagttggactggacatgccgtgtaatgcaccacgacgcggttaactcgggacggaagcaacgcaactcggcacgaagaaggaaaagccaccaccggttcctccgccgtccccgcggtttcagttccttgcttgcttgcttgctcttgctctccctctctcgtggaagccagccacacaaggcagaaagagagagtgacgttgtgttccatcccgttccgctgaagcaaccgctctcctacaccaaaccacccacaccactctaggtctctagccgatgcg

SEQ ID NO: 11822 - DNA, 51 bp, Zea mays
cgctctgcttaactgaccattatttcccgtctgtttttatgtagattttaa

SEQ ID NO: 11823 - DNA, 578 bp, Zea mays
ggtgagggcctctagcggcaacgggggcctttgcccaaaatcacggcaagccgaggttccacctggaaaaatccactccgttgctctctcccttttctctctctctagcatcgacctgtcgaatcctcactggtctattcagttcggcaacgaggagagagatagacagagagacggacgggaggctgacacatggccggatattggggtgcggaattgaatttggttaatgcaaaaggtggcgtgtgaggacggaccgacggaggcaatcacgagacgggaggggttggccttttgcctctagggttccgggtcgcccaccaccttaccggaaatggcaatgcgggacgcgccccaatcactcaccacaccacccctttcttctcgcccttttaacccaatcgtctctccaccacccaactcctcctgcctgtgctctcctcctttttctccactccgcttttgcttggttccatcgggccggagaggagaagctagctaactagcagcagctctgttggtgtgtgtgtgtgtggagggtagctgcagctggggctagctggaaagggtcgggagcc

SEQ ID NO: 11824 - DNA, 104 bp, Zea mays
ggtaagcatctgcataccttttgcttcactgaggcgttcctttgcattgcaagtccgatttccatttgccattttgctgcacatgtgcaggttttagttagata

SEQ ID NO: 11825 - DNA, 614 bp, Zea mays
gaccatcgagtatctcatatctgctcaacgagaccatggttgacggagagagcagcctgccagcctctgcctaactcgccagggagggccggaccgggcccgtgcatcgccgcaccggtgctgcggtgcatgtgccggcgaatagaatactactacacctcacaccacctttttaggcggatcaccccagaaagtctcgcacttcaccccgcactcactccccgaccccgagtcacgcgagcgcccacgccacacgcccacgtccgcaccgcccggtgcccacgcgcccgcccgagtcaccatctccgctccgcacgcgcagcattaaccctgcgggctacggcactcgcaccgcaccgggcgccgccccaccgcactagtgaagtggagctggagccgcggaggcggctggctgggctcgcgggagagtctattatttccatcggcaccatcacggcagggcggcgcgcggcgcgcgcccagcgggtttacagacccttctgtctctctcgctcgcttccaacgctcgcgaccggctctccctgcgcccgttcccggcggccgaagcgagtcgcgaacccctttccgtggctcccgagcgagtcctacgggcg

SEQ ID NO: 11826 - DNA, 789 bp, Zea mays
ctcacgaatatctaatcaaatccaaatttaaaaggktgaattgaaagttkgaaggcttgagaaaagtaagacaagaaaatatatgacaaacaaatggagttagacctaagcggtcgttgaagatgttgcgaagcggacgttgaagatgttgcaaaacggtcgccaaagacgttcaaccagatgagtgtcttacctcgttgtcaagatatatagtaccgagatcgacactaaagtgtcgctatattatagacataggttaaatgtgctactatattatagatataacggtgtctacaccaatatgacttataatgtaaaatcgtggtgtcatatggcgttagccgattccatattaaaaaatattttagtttatcaaacatctaagcatcattttttaataaaaaatatggccaaaattaaaaatgaaaatcggcgacatcaccagagggttagggatataactgacgtagatattattcgtttgtattcagttctgtttttattcagttcaatccgttttaagatatttgagattcgatctatatttgagttctttttatccagtatttgatatgtatccgatttatatctgaagatataaatttaatgagagaaatatgaaaacaaactgatccgattacctcctaccgtccgacccggctccctcggtccctccctcggtccctcccggtctcgcagttcctccccgtcgtcttccaccgcaaatcgccgaagcaagcaggcgagctcgggaccagatccactgcgggcagctggagcggaagggcc

SEQ ID NO: 11827 - DNA, 204 bp, Zea mays
ggtacgaaatcatccatctcgaaaactccaaatgatctgatcatgcagacaaatacacatttgagaacaaaacaaaataaaaaaaaataaactaacaactaacaaaaataacgggtatttatgtaggagacatttgggggatgcattgaagccggtgcatctaaatatggtgaagcagtataccacagagatctctttgaagga

SEQ ID NO: 11828 - DNA, 1500 bp, Zea mays
tgaagaaaacaatccatgcgtatcttataagtatttatattggctcgattccaagcaacctttacacttacattatgcaagctagttcaattatgcacttctatatttgctttggtttgtgttggcatcaatcaccaaaaaggggagattgaaagggaattaggcttacacctatttcctaattgattttggtgggtgaattgcccaacacaaataattggactaactagtttgctctagtctataagttatacaggtgccaaaggttcacacttagccaataaaaagaccaagaaatgggttcaactaagagaacaagggataaccgaaggcagccctggtctggcgcaccggactgtccggtgtgccaccggacagtgtccggtgcaccagggaactccaagccaaactcttcaccttcgggaaaactcagaggcgctccgctataattcaccggactgtccggtgtacaccggacagtgtccggtgctccaaggaagagcgactctgaactcgccagcttcggaaatccgctccgctataattcaccggacatgtcaggtgtacaccggactgtccggtgagccagcggagcaacggctacttcgcgccaacggtcacctgcagcagcaattaatgcgcgccagggcgcgcagaagtcaggcacgcgcgtagtggcgcaccggacactctacagtacatgtccggtgtgccaccggacatccaggcgggcccagcagtcagagctccaacggtcggaacccaacggctttggtgacgtggctgacgcaccggacatgtccggtgtgcaccggactgtccggtgcaccatttgacagccagcctgcaccaaacggctagtttggtggttggggctataaatacccccaaccatcccacattcaagtcatccaagttttccacttctcaactacttacaagagctctagcattcaattctagacacaccaaagtgatcaaatcctctccaaactccacacaacgccctagtgattagtgagagagatttgcttgtgttctttcgagctcttgcgcttggattgctttcttccttcttgattctttcattgcgatcaaactcacttgtaattgaggcaagagacaccaatcttgtggtggtccttgtgggaactttgtgttccaagtgattgagaagagaaagctcactcggtccgagggaccgtttgagagagggtaagggttgaaagagacccggcctttgtggcctcctcaacggggagtaggtttgagagaaccgaacctcggtaaaacaaatccgcgtgtctcacttcattattcgcttgcgatttgttttgcaccctctctcgcggactctattatatttctaacgctaacccggcttgtagttgtgattatttttgagaatttcagtttcgccctattcacccccccccctctaggcgactttcaattggtatcaaagcccggtgcttcattagagcctaaccgctcgaagtg

SEQ ID NO: 11829 - DNA, 634 bp, Zea mays
cgaaaccgggccccaccggtctccccgtcgccacgtacgcggccggagcgccctatacaagcgccacgtcgatcgccgactcgccgtcgccgcgtcccccacggctcttccttcatcctccggcgagctataaatccctcccgccgaccgccacccccagggcaccccgcggcaccccctccacccacaaccccccgaggaccccgacgtcgtcgaaggctaacccttggcccgcgccctccgccccgccgctgtacccgacgctctccatggccgacctcgcgcccgtcgagatagggcccgcctcgtcgccgacggcctcggatgactacaacgcgcctccgccgtctgaggacgtcctcctccgggtccccggcgcgcggctccacctcgtcgaccgcagccgcagccacccgctgggccgccggcgacctctccctcctccgcatccgctccggcgacacctccctggccgccatcgcgctgctgggcccggtccagtggccgctcgcgcgcgacgtggccgccgtcaagctggatccctgccactacgccttctccctcaccgtgccggcctccgccgacgaccccagccccgacccgctccactacggcctcacgctctcccgccccg

SEQ ID NO: 11830 - DNA, 1500 bp, Zea mays
gaaatatataacaagtactcctccgtcccagaaaaattgatgttctaggatttaaacaatgtccaaaaaaacttgttcttttagctcttgggcaataggtttgtccatatcagcttgagcttacagtcagcatgccaccatgcttccttttaacgaggggtttgttccttaattagcatgattcaccttcaataaatagggttataggggtacatgggtaatttttgttggtcactaatctgtcctaaaatcctagaacatcaagtttttctaggaccgaaggagtaagagacaaaacattctcgacctgagctctaaaaattcacaaccaccaatcccaaggaatacgggacatgtaagcaagattattcttgggattcataacgagcacaaactgtgcatgtaacattgtaacaacataacatatttcctaaccctgaaccccaaaatggaccacaatatggattgttctggcttgatagatccaacataaactaaaagaatgccccaattgttccataagaagcaaaaacggtggcatttcctattctctaccccatctttgaaatatttcatcatgagtggtacgattttgctcgctatactttacacttgcagacacgctgcagagcatttccttcttcaattttcacactgatggtcctatcataataaatcatcgaggcacctatctgaccaaaattcacttatttctacatgcagttctaattcacgagtctataaatcattcttcccctatgaagatcgcacctcagaccatacccagcggccaattctttcgctggtcagtggccacaaatacattgggaaaaaaaagtaatagtgtgagtacggaaaatgactacctcctatctaatcaaatatggtagaataatttggtcacccctccgtgacggtaaaacattcaaactaaattccttaacccgaaacaaacagatacgagccggatctcactaggaatcgtgtagagggcgatgagaaggacgaaaaggagggggcggcggcgagtcgagatcgccagcggccacctcatgctaaggccggggcgcacgcaacagtttggccgtggggtgtgggttcgtagctcaggagcacctatcctggtgccgcgtcgtagcgggctggtcgacggtcgggcaccggcgcgcgcctcctcttcctcctcgtcctcccaaacgagagaaatggagctgattcttctcttttcgccttcgtcaatgaagttcgtgggagaacaaagacgccctcattttagaactacgccttccaactcataaagcccattgactctgatgatcctcaaagcccatttagatacaaggcccaacaagtagctagcccatatgattgcacaaatgacaaatcagaaaaaggacgagacccattagcgaccggccagtgatccccgaccccgagtcccgaggccgacgccattcctgattcctccatcttccgttccgccgcaccgccgccggagat

SEQ ID NO: 11831 - DNA, 220 bp, Zea mays
cactagtttcgactttgccattgcccatggaactctatatttaaaaatttaaacaaaagattatggtcatgcgacatgttaacaaggagaaacatggcatttttttccgaacaagtaaatttgtcaaagcaaatcataacaacagcgtaacagaaaagggttgggaaacataaactctccaattcacaagtcctctccgctaaatgccatacaaactaag

SEQ ID NO: 11832 - DNA, 850 bp, Zea mays
ccgctttcatgcgatcctgcctgctgccgtgcacatcactgttgttgtctgcaactcgatactgaaaaagatatcccaattccgaagaaccaaacggcccataaagattcggctacttaaagaggccacttttctgaggggccggcccgtaacgattgggcttgggcgctgcgcttggcacaagaagactgatcaggaagctatccgcgctccacgcaaatctccccacgtacgcggcatgcatgcactttctcctactcatcgcatctaaaactctggacggtcggcttgggttctgaagttttctatgtttagggtttatatataggactaaaaaatattcacctgttgcccgggtctcccgggccaggacccggtccatcgtgctgcagttacctagcgccatatgcgcatggtctacgtccactaattctcggtacaccgcgaagcctgtgcgccgcatctcccacatccgtggtcgccatgcagtgacacggtccatagatgacgtggcgcgtctagacctcttacagccctcctacgctgactgcgagcgaggctcaagcacataaaaaccattcgctctgcgggcgttggctcctcacagctctctctcaatcgctccctgagttagagctgtcgcaacgaagagaaataactcacacaaaaaacacaagggagcctcccgatcatctcggtggcgatctcgaataagatccggtgctgctccatgatttgaatctctcggactgatcatgacaggaatgccccctgcagtctgcagctgattgcaggggacgtctgctgcctacagctctcggtctcggatgccatagaagagttggtcccc

SEQ ID NO: 11833 - DNA, 705 bp, Zea mays
aatcaatttccaccggtggtttttaactaactgccaatgaaaagaccgatttctacatacccttagtactgaaggttctaaaagtaggttttatctgcatctatagagtttgtttgtactaatgctaattaatccatggcacacctaagctagggcagagaggaaaagggggaagccctccctctctccctccccagtcccgagccacaaagcagggaggacgggaatctggctgttcctccgcggggcccggcagccgcctgtgcgcgctacggcacccggccactcgcgccccggccgtacgtggtcgcccaccgcggcaggcgccgcggccaaccggcagtcgacagcgacgccgcccacgcagagcagagcagcgagggagcgtgcagacactactagtcaacctgtgtactcgatccgatccagtgtcagtcagtcccctgcccgcccgccctgcgtgtgcgtgctgcgtgctgctactatatataaattgcaagcaagctaggcaggcaggctagcccagcgctcggccctcggctccttaaggcttcatcttctcaagttccggccgtccatcgccgccgccggcctcggccggctcagttcctgcctgccagccaaaaattccacaccacccacccagagactgaggcgcgcggtggtgaagacgtgatcgaaagtcgaaaccaaaacgatatatag

SEQ ID NO: 11834 - DNA, 429 bp, Zea mays
cttttagcactcatgtttaatcttccaatgctaaagtttagctaaaagtgctaaatttagtaaattgctagtaaaattagctagctaattattaactaatttacaaaaatagctaataactaaactattagctagggtgttcggatatcccagctaattttagccgctaactattaactctagtgaatttaaacacccctaaattttagctagcgtaaagtgaacgaaaaaaaactacagtatttgacggctgcggcttaaatctgtgatcaaagcatgggcctaaatatggtcgattcggcccagaatgattaaccatgcggcgaccaggtcttcacgtcgcactgcgatcacggcttcctttctctgagcaatggcccccactaacttaaaacctctcgtcacttgtctccttcccccgattcgcct

SEQ ID NO: 11835 - DNA, 1500 bp, Zea mays
atggtcagtgcattttttagggaaaagagttgtattttcctattaagttcagtacttcagtatgctacatacaacacactgtttattttttgttctttcctaagctaatagccagtacacgtaaaagaagctacaatggaaacagtggcagatctaggtattacctgtagggtcacccggtctcacaagttttgccaaaacttgtgctaattgacttaaaattaacaagcttgaccccacaaattttgaatcctacatgccactgattagaagatgtgcatatgtttcatcttaatgaattgttttttatgtcacaacataaaagcattgacatgccatctagattattttagtatttgcctatttggtcaacaaaatatgtgtccacattaattctcaagataacataggtagtaagaccgataacatcaactatgctacagaactaagtggtgtttggattaggttggaatgaaaatttgtctaaattaggtgaatctgtccaactagttggctaaaagctagttaaagatttgataaaaaaaatagtccatctattagccatcttatttggatgagctaattttatctaatttttaactagctaataattaattctcaggatccaaacaagcactaagcttcaggtctattatctaaaatctagatccatatgtactcaagatcatgaggttagccaactaataatgaatgacatcgcacagatcgatcaaggcatatcagtttttttttgtggcgaaacaggcatgatttatgcagatcaagttgcataaaatgaaacaatgtactagctagataattaaacggtttgtcttgttaaccctatctgaacaatctatataagaacaaaacttctatttgactatttccaccatcctaaaaagaatgtaaatttcgtttatgatgagttaaaaagatcttaggtttgattaagtttattaaaagcatcaataattatatttttaaataactttattatgaacatttgttcaaagctcataataatgatacttattgtagttcataaatattaatacatttaaatatattttttggttaaactggatattatttgactttttgtgaaggagatttatattcttaacccctgcaggcatgtggcctgtgctatctaccgttacacggcgagctacagagttgtcgccacaacattgtagtgtccgcagaggatggtgccgacatggcaagataaaatcctggtccagcaagatccgttcttccaaatgggatcaggtgattggctccagctcctcctcccctcagcaccaccagtccccctctgctcctcctttcagtctcagcccaatgacaaagttctaagcagagtagtgcacgggcagcacggcaacggcatagcacctccctccaccgatcatccagttccgcttgcgtaacgacttcccttcgcaagcaagcttcccgttcagcccacccgcaggccgccgtgctcgcgcgacc

SEQ ID NO: 11836 - DNA, 787 bp, Zea mays
aacagaagatatatattttgtgttttgtaaaacaaagtctatcaataggtagtggtttgaatatttgtttgttgtacatccaccttcatctaaccaacagaacccacatgttttcgtgatttgttaaaataaagtctaattgtttgatatatagaaaccgtaacaacgcacgtgcaattagctataataagattacatatttatctcgccaatataatagttttacagtgatattttgccacatagattttgcatatcataatgttgtttatcgtttcgtatctatgttttatactattttttttactttcgtagcaacgcatgggcatgaacctagtcatatatatgatcgcgtaaaaaattattttatattgtatactactgtttataagagttaagtttaaaatagcggttgagatatgagatatgatgagtaaggtgttgaagacaatctaagagtacggatcgtcgtcccaccaaaaggagggactacgaagtaaaaaaatacatatatgggcggcataatttctgttaactttttatccggggtatagtgttgaattttgaatatttttaaatatgaaaaccaaaaagatgcactatgcatcgatgggtggacattttgcaggctccgaattttcctcaaagggtggacatgagccgaaattcatgaggtggcccagtaacagtagtttctcttaaaggctcaaggcatgactcctccatctccactcgatcctccgtcttatcaccggtgaggtactgaggtgagacgatctccgccacc

SEQ ID NO: 11837 - DNA, 1500 bp, Zea mays
tgcaacttgccaccgcggccgccgctgcagtctggctgacacacgcaacggcaccttgctgcatgcatccgcagcggactactggtgagtgacggacggcttgctgccccgcgctgacgcgcagcagcgaggatttgctagggtattccgcctaaaccataataaacactagaccctaaacgtagcggacgaggaaggagctgccggccatggcgttggcgagaaggcggcagccgtgaggccatcgccttaacgggtcggtgtgaggcccatccccatctctacccccacacccatgagaataacggatcatgcaatgcaatcccaactcttgcatttgtgtgattgtgtcatagaaaagtcgcggctagctgtggactcttccgctacgtacgaaatggacatgcatgcatggagacacgaatggtttcttccgtcgaccaggacgctggggttcttttctcgctgcccgtcttgcattgcgggaatgcgggatgcttatgaacgttatctgaaccaacccttccgttttttaggattccctggatcattaataaggactttatttatgactgcattcgcatgttgatctctctctctttccggacgaagaaaaaaaatcgcaatcgtttcatacatttatcacgtacttgttcctgccgaaagagctaagaaggttaatgaactgatgctccatatgcaaacagctactcatagccgtgctggcagttcagtactcgaatccgatgggagttattattagtcgcagactcttctacgtctaccaacgtagcaataattcagtaccgcgtgttacatcaacgttaactacaatattaatttcctgaaaggcctttctgtggtgcaaatacagacgtctgaacctcaccgcaacgtgggcggaaaaatctgaaacacgtcaggactttcacggtggcctggcagcaatggttccgattaaaaaaaaaatgtgtcgttttcctccaagctacttgcttactactgtgacagctctatctacttctgggtgaaaagataccggagatcccggcctgctactgtgcctaactctgcctttcaatctctgttattcacgaaagaacaaatgaatcaggtagtaacactacatgggttggggctgatgtgagcgctaaacacaggaacatgtttgttgcataccatcactgagctattttgtctgatactccaatactacccgtgaatttcttcagggagaaaaaacaaccagcagcactttcaagaagacctgtttttcacccatagttctttttttgggatggatttgagaggagtttatttgagattactctttactggcatgtaaagcaaagttgtgctctcttagtctcttgtatatataaggcagtatttccttaccccgtagtccactccacatttccactccaccgtttcagcagcaccagcaacacagccaaagcccaaagaggcggcagcagcacagcagctcggcctgttccc

SEQ ID NO: 11838 - DNA, 1500 bp, Zea mays
gatggaaaagaaaaagaaaaaaaagcgagcggacgccgatttgggggggtccgattcgtttggatcgtgagtcggcgccgatgatgcaatgcaagctgatgaccactagtccactacaacaaacaaaggcagcaacccaagctcgccatggaatcttttttttttgagcctctctggataatcttcgcgggctgcctgagcccatgcccattcgtgtcgtggagtagtgcttacgggggggggggggggggggtgtctcgtcctctaccttttataaactcacgaaactaacaacacacagtactacacaacaacagccacatattttaggccatgctctaaagagttaattgttaatcgactaataagttgtgttgcaacagctaacaattaagttgatctatttagttgaaatgttctaaatattccagctaactttagctgctaacacttactttgagaggtttgaaacgtgaccttaattgattcattctcctattgtgattttagtagaaagtttaaacacggatctaatccatagatttatatagataagtatgacatatgtgatcgtttgttagcataattaattttcctataaccaactggtaatgcataattaggacgaacccacaagcataaagacggaaagaggaataaactaaggaccggcgttgtgtgttgagcacatcggaggcgctgttatgtgaatcagtcgacatgcatgatcgagtgacgaccaagaactacaccaggagggcactattctgcgcatcggtcaacatgatcgggtggtgaccaagaacaacaccataaagatgaagcagtcgcgacattttactttccccacattttacttattaatagctaaccactagaacacactatttaagctgattaaattttcttccagttagcaatctagggttaatattctaatgacactattttctgcgggaatgaaatgtccacggccaggcgcatgagcatggaaggccggggaaggcaaaaattgggaaccaaaaccaaggccacccctcgccactcatttttccgattttccgcggagcaggtttgctcacgcggcggcagcccgctgggtgccagcgccaggagcccaagggaacccgcgcggaagccgcacgagccgcggacagcgaccaacccgtgctgctcgcgcgtccaaatcggacgacagcgccgatcgaaaagccccggatcgcacgcgcatctctcccttgtcccccacggccccactcccccttcccacgcccacgcgccggcgccgctaccgcctcgcctataaaaggtcccggccgtgcccggcctcggttaattcaggctatcatccagtcatccatcagcaggaggcggggagagtgacttggccgtggcccgggggagggggagagtgagagctgccaaggatcgcatcgaaggaagctaggagatcatccagccgccggcaagaaattaggcagcagcagtacgtcgaggaag

SEQ ID NO: 11839 - DNA, 1106 bp, Zea mays
gtcagttatatctcttaactttgcccctagtgcttgggaaataatatagtaatattacactgccacttagtaaaacaagaacaagttgctggaagttttctgttgtaaattctaattgtccaaaacataaaataaattttcttgttatcaatgaaggcccaacctgcttggaaacaaaaggctctgttgtattatcggctaagggcccagccacaatatggtttacaataatcacatctccacactttttcatattcatatttgaagcttgatgtcggtgattacatgattttggaccaatagaatgcgtcttgtcaaactaattgatgcatcttttgctaagtgttctacctattcttatgtattacattattatagtttgaaccataatcactatttttgagctaacatttgcagttcctcaataatattattaattgctcactgagaatcaacattattttggaagtatcgagtgttagttatcaatgtgaaaagttttttactggttagtgggaatggcaaaaaaagatcatggtcctcattataaattttgatctaaaaagggtaggcctagtgccgtaggctctcatatgaatggtgtctagggaagagataaaccgagacaagccagacagctccaaacacgcgcatggtgactcagtgaggcaactctcaccattgcaccaggcctaccctacataaattttgatgatctaaattgtaaatttcaaatgatatatttgttcatgttctcaatttgttttatagctcattgtttcattgcacttttgtgctggactttcaatactcgcactctctccgtccacaaggatgcaattctcactttgaggagtcaaatgatttgaaaattgaccaaagttataaacaattttaacaattataatacaacataagtacaattaaattagttatattgtagtaaacctagctgggacataaacataatacttttcattataatacttttyaaagttaagctagttttgcttgcacaattctatagtttcatccttttatggactgaggtagtaattttttaactaaattaactccttttaactattttggtgatggattatcag

SEQ ID NO: 11840 - DNA, 314 bp, Zea mays
gcgacactccagatgtggacctttttttttcacaggtttcggagctagacatgtcaagtagtttccttcggttgttgattaatttgcccactgtgatagagattttgcaccttgtggcctccacaagagttacttagtagagacgcacgttggaagggcttccaagacaagtgaagctcactagctcagcgttcagttgcttcccacgcttcaccaactgaacaaggtttatatatatgtcatatgatcctatctagtacttattcttagactaaaaacactatgagttagtgctaccaactgaaggatacgcc

SEQ ID NO: 11841 - DNA, 148 bp, Zea mays
agtacgatcatccgatccgagccgagccgattcagtccatcgtctccctcttctcttctcctccccacaccattatttattgacacaccaatcaacgaacccatgcgtttgcgcaggcttccttgagtcgctgtggcgggacatcgac

SEQ ID NO: 11842 - DNA, 658 bp, Zea mays
gttagtcaaaattgtaattatgcttctaacgttgtctcctaaatttggaggtatctcgttcggtatttggcttatgattcacatatataaatataaatattggcagctaattcaaatgtactaaacgttcatgagagcgaacaacatcgaagaaaattcaacctgtcccatgcattctaaacctcatcgcatgcggcatgcccgtagaggcaacaggcaagtgagggagacgcagtctcagagagagtagcagcaccagcacatgcacatgcgtccacgtcatcatccataccatatgggccccaatggaaatccaacggcgtgacaagcagcccaatagcattccagcccattcgattccccgcgccgcgccagccaatcggcttcgagataagcgtttttcctggacccacctcacgtggtgctcgctcctcctcgagccacgcagaccaaaagcgcattcaggggccccacatgctcgcacggccgcacgcgatcaggatggtggacgtcgccaacctgtgggtccgggttctcgcgacagagttcccaatttttttttataaacgaaaggccttccgagctcgcccccacactgttcctggttttgttaagctctcgcttaacctaaccgccgggagcagaagtgttcgacgaa

SEQ ID NO: 11843 - DNA, 1500 bp, Zea mays
gtgttcgtcggtgactgcaggcttcgtcttggacgatgatgtgtaggagtggcgatcctgcatgaagttgatggcattgaaattgcctgcggccgaacgcgatactaggttgtaaagggcgtcatggttgggggtagctagacctcggcttggagttcgtagtctcggtcggtaatgacgcggagttgttcccctggatgccttatggtgaaggggacgagattaagaagaaggcagattgggaaattgatccgttattgtttaatactaaaatgcgtctgttacaagagataagtagcccacgacaattccaaactgagtctgccttcaaaattaactgagtcaattacaagagataagtagcccacgaccactaacagcttggagatgaaaactgctaattctaggcctgattgccagctttctaaataaacttgcacggtccaactctgtctgcggtgatcgcgcccttatggcatgggcgacgcgctcctgtccgcgtcccttcacgggcccatcgctggtactgcttgccccacatgacaaaatatgctgtacctattctatagtgaacctctgattttcatttctttttaagaatgtatactttggtcctttgtatccttgtagcaaacatgaaagaagtttcttaatgcatctctatatcttttctattagttctaaaatcaattctgcaggcttttagttctttgcttggtcttcattagacaaatctagttacagaaagaatggtcactggattaatttacctaaaatttgaagccaaacctggctctaactaaacaaaaattgtgcttgcaaaacatttgattgatcacctgttcagtggagtgcagccaagctgagctcaagagcacctacctatgtactacgccctcttaaaagtgcacttctgacatttgtgagaaaaaaagaaatagatacaaaattctgtagaaaaaatggccatatgtgtcaatgtgtgctacactgcttgttccaaaaaaggcaaaaaccccgtctcatttgtgcgaaggaaaaaaaatcaaattatttctcctgtctttcgtgtaactcgcgtatggtctagtttttccacaaaaattatctgtgttgacatacttgttcatggtctacatgtgtttatttgttttttagaaattttggaagttcacaaagtgcatgtttcaaatatttgtgccgcattgtgttgtattaatgtcctcgactcctctgttaataagggttatgtttgacttgtcattagcataaatgtatccttcgataaaaaaacctaatctatagttttcaggcaccatgttactcatgtctccattcccggggatggatctaagtaaaatggatcccgcgactctgaccctccttggggcagctggttgtgtaatgctgactatgcatttcactgtgcaactggtgtcacaacatctcttctattggaaaaacccctaggagcagaaagctagacttattattgtgcta

SEQ ID NO: 11844 - DNA, 178 bp, Zea mays
ctgcagttgtttggagtgaaacaaaagactgatgcagctttgctctaattaactatactgaccatgtgcatagggccggccataggcggcatcgaacacagtttacacctcgtaatctccatccatcctcgcttagttaacatcccaggcagctccactactgtgctggactccagaa

SEQ ID NO: 11845 - DNA, 1500 bp, Zea mays
gggaacgaggacagagagaggaattaaaagcaccgcctgtcgttgctagccatgacacaggccacatgaagcacccaaggagccagccagttaaagcttccttccaaactcctatttggccgcaccagttctttttttttttacaccaccgaccgcgcgcctagcctccctttcaccatcgccacgtacttgatttgtttccgtcagttttaatttctcgtagccgacgacgaatggcaagcagtgttaaagcttagcggtccgttcctgtagttacagtgatcaattgcaaatgcggcacggaaactaactagccaccggaggaaatgacgtagtatgtggttattactactactctactagcatattgatatactgtatacattaatgggtatgtacagtgacgcacaaattaaaaggagcagcagttagtagttggaggccaggacacataaacgcgcaccaccaccaccacgccaccaaagccagagatcgagaggcggggaattgattagatccatctaacccccttggaagctagcaccgattatgaccagtgtgccttgtacgacacagctgagtctgtgcatatgcaatggtttagcactgcctacgcatgcacagacagacagatgagctagcaaagtagtacatatatactacagcggcatgcattatttcacacacttggctacggacgggacgacgatgcagagagcacgccgcaagggtttacgaacattctcgcgtcgtgttgtgcgcgggcttgttttatttgtgtggctcgatcgacgaccggtcaccgctcaccggcgctgtaaagtaaaactctccggcagcgcaccggccggcggcgtatacgtcccatctgcccaccctctgcctgttgctcagctgatccatggcatctcgtccgtatattaataaaattaaaaaccctgtatgtttccctggtgcgcaggcagtgcgtgatggagatgcatggatgggacgaggtgcgatctactcgatcctaattaaggcctaaaagtttcaccgctggctctctctctggaattccctctctctctctctctcatattcgcccccccaccacaatgatatgcaccaccccttccccttgcccctcccctccctctctcctctaatgtcatgcggccttttgtgttgctgttgcagctgcctgcctgcctgcatataattctgttgcctttagctgcttgcttgctcatctctctccccattgccaccatcatcacctccatatcccctcgccatcacgcctgcctgcctgcctccctccctccctcctcctttgcactaccgccgctacaaaagagcacaccgcctgcgacctagctgctgccctgttcgtcacaattcacgtacacgacgacgagacgacccctgcgggcagatcttatcttccttgacctagccagttgtgcaggcgcctcgggggccggggcctctccatctgagtgttagattacccacccg

SEQ ID NO: 11846 - DNA, 246 bp, Zea mays
tggcatactcacgacaactgcactgctgatgcgactgagcctgggcccgcctgtgctctgctgtgcggcgaaagaaaaccaacccaaagtcccaaacctgtgtagccttccaaccaaaccaacccacgccatcatcttccgtcaatccatccatccgcttgtccctaccacctccaccaaccaaaacccccaaccgccgaggtcaccggcgactccgtcctcgccgcgccgcgccgcgccgtgagg

SEQ ID NO: 11847 - DNA, 839 bp, Zea mays
aattattatgcactattttaaagttttataagataacaaatgtaaaatatagtcaaaacacttacttattctctgatattattaataatatcttctaacattttgtgatacaaagtcattgcttatatcattgagataaatctcatccaacaactttttttgatatatagaatcgccaagccatttgatctctcttgagttattgttggccataaatagttcacaaaaatatttcaattttaaaaagcttctctctatcgatgtaaccatcatatgtatagtaaatagtactctctctatatcaaaatagaatttgttttgcttctttagcagattcatcatcatctagttgaatataaacataaaaatcaagagctaaactatcttacggatagagtattcgataagtaattgagatattagtttaataatctaaacgagactggtcgatagcgcaatcgttttttgcgtatttgtgtctagaatagataaatttaataggaaaaaatgctagcgtttaatggctatggggctctatatttttggggctccggtgcggccgtaccctcggcaacccctcaggaacggccttgcctggaaggctggaacagcatgtcggtgacgccgaagacgcccaactggaacgtgactgtcgtccacaccatcacatacgcatacgccgcatggccaccatgagcaaaccgctctgactcgcgccatgaccaaatatctgaatatgaatatcaagaagagggagggagcatctacactcatgctctttcacgcatcactccctcgccactcgcgcgcccgggctccttcccgccacgctcacgacg

SEQ ID NO: 11848 - DNA, 1124 bp, Zea mays
ggtctgatcgcagccggccaacaacttacttcccaagtatgatttcggtgacgatctgtagattaatgcatgtcactctgctatacacagattaagttgagtgctgttactattgctgtaacatagtaaatatgtcatgtgcatgagcagtaatcaagagtgaatatatacgtagtaagagtatcatcaacgcatgttcattaaagcttcatctgtgtatataatatactactacgttggaaaagcagttcgttcgctgtcgccatatagatgcataatgcaactcctgagaattgtgtggccgtaacaatcacacgtatgtattaaagcttaaactaatcttcagcgtctcttaggtcatactcggttgcagctggattaattggagggggtttaggggattaaatttcttcctgcctaaaaattgaatagacaggaatttaatctctccattatattccagccttttcaattcgctcctaaccgaactaagcttttagggctagtttgggaacctaattttctcaatgaatttccattttttcaagagaatagttcatttggaaaaatggagttctcaaactagcccttagtgggttgagaagttgacccatctcacagtctagtgtcaagtgtttctgccagtagtgttcattcagatgctcgtacaaccatatggatggatatgcatgttcctgcagcgtttttatcctttcatttttcttgtttttttttcattattactggctgtatgcagaccagggccacctcgtgtgcctcgtgcatgtatatataattacatatacgtatgcattattgttgagcggtggagcatgcagcctgtgtaatcctgatgagcgatgacacacacacatgctgccctgttggctgcagcagcagcagctctataaatacctcaccaccgcgcatactcgcttcacacaaagaagctccataattaattattgcccgtaagtactgtgcctctctctcttaatatatattatcacgctcttggattttttgcaataacatagtagtagctaccagtagtttgttagttttcgtttaacgccatcatcgattgatttgcagtttcagttcgccatcggcagccgagcacc

SEQ ID NO: 11849 - DNA, 1385 bp, Zea mays
ctaaaaaaaatcgggtgaccaaggtaagagcacacacgagcacataggttttttactagcacggttaggagaattggccggtacagaagcgttctgcgtttgtctattttcattgtctctgaccgggactgcattcgcctggtacgtcacgctacctgctaactccattttttagtggggagattttcagcaaaaaattcatgatcattttttctatgacgattatgggttagacttaatagctttacggcaagggaaggaagaatatgttaatggctacattcggaggttctggacacaagaaacccactttgcagaaaaaagcttgcaagactagcttttaatggaatgtgatattatttaaaggaaacattagaaggcattcaatattttacgctagctcaattgcactagagggctttggtttgcgaaagccgaatcaaacatgctactaaagtggtttgtcacaacgtccatgtggtagaatgtgaccatagtacctcggacgacgaattataagaagtccagaagctactgtatgcagtcctcttcacatcatgcaagctatgccactactttgacaatcataaggtcatattagtcactagtttcctaagtagggacatactgcacaaccgggaggcggtagggaagagtgggcatgcgagttgggagttcacaacatcgagttcccaattagtgactttatatagatatacgctatgtctagatatataatattccctccgtttcaatttataatttatttaactttttttgttcatcggctcgtcgtattcatgttttttaaaaaagttaaaattttaaagttatatctaaagtatattatatacaaatgatatcctagtaaaaattaataataatattttttcgaataagatgattggttaaatttgatgaaaaaatcaaataaattataaattagaatgaagagagtataaaataaaaaataaaataaaatattttttaattaggaccgaggagtatgattcattagagtactattaacatctaatagaccaaagggaccctaaatcacgagttcacgaccaagcatatgacaagcaagcattattgtactcgagtgtgccgtatgccctgcccgtatatgtactctctaatctctactttcgtctttctatgtcccagggcttgttggttacgctttgatacgactataacttctaaaatatattttaactctatggattacagaacaaactgatagcctgtccccacatgtcaagcactcaagcagcccttcctgtgctggtactagttgtcgctgctgccctgttgcggcgacgactccgtgactcctagtccctacccagatcggcgcccgacgcaaggccgagcaggcg

SEQ ID NO: 11850 - DNA, 651 bp, Zea mays
ccaattacccagagtgtcaaaaaggcgtccgctgtgagtgacgacggatttcaccttggcatcatttgttatcaggaacaagaggctgctgctgtcagctggattgctagcatactctggagcaacatagccaaactccccaaagtccccgttcaggaaaggactggtatcaccaccctcgccaggcgccatccggaccaaccttgtgagcccaacatccgtgatccgagcatcataatcctcgtcgagaagcactgcactcgagctcaaattctggtgaatctgcggaacctggaaccaatggtgcagccacgcaagcccccttgctgcccccacgggggtcctaagtcgcgttgcccaatccagcggcgcttcccctggcttcttcatcaccgatgaaagagccccactctccatatgcttatacaccagcagcctctcgtcctcgacaacacagaagcccagcagtggcacgatgttaggatgccgcagctgccccatacgacccatctctgccctgaacgccttctccgaaagtgggcacgagtgcaggcgcttgaccgtcagcgcagacccgtcccgtagcacggctcggtaagctgtccccgcccgcgagctcccggcgaccacgatgtggctagtgctgaagtc

SEQ ID NO: 11851 - DNA, 104 bp, Zea mays
tgtacctgcaaaactattaacatcttctgatccttcgaagttgcttgcattgcttggacgcataactataggactgtcttgaattcttgatacatctcattacc

SEQ ID NO: 11852 - DNA, 461 bp, Zea mays
gattaggttgcttttaaacgggacctaaaagttagtttttagaaatcaagcaccctttagtcagcagtttaacaggttagagataagaaatgactaaactttacttggaaaccaaacaggtccttcggtttcacaatccgtcggttggtggcttggtgcgcgcgggcgcgtctggcgtgcagctgcggcacgacacgaactagcgggacgcgggcgcggcagcagcgggtcgagtcgacttccccgacgtggtctccttccgctccacacggccacacccacagaacccaattccctcgcgcgctcccccttcggcccttgagcccttccaccctctcccaggcatcacacattccaccaccaccgccgccgccatcaccactgtgaccaccagccccacactcgtatgtgattattggcacccggacgccaccgcctccgcctccaccaccgactgcgcc

SEQ ID NO: 11853 - DNA, 712 bp, Zea mays
ggtgcatgttgatcagcatgcttgatcatctaataatagacgttgcttgaaagaaacttgatttgcgtagccaagagcaagggcttttaagtaataatctgtttctctgcatgtttttgtctcaatctcaacccaagctagctacaccctccgtttctaatacaatatctaaacgtgtctagtagtaaaagttatcctaattaaaacatcttgttgggatttgatacacagaaaacatatatttcctcatgccaatttccattaacaaaatactagtacaaattacatttgctttttttaatcgttatcatctccgcccgctccatgcctccatggtcgtccatgcccatccgcacccccccccccccctaatcggaagtcggaaacaactcgagtcgacgtgtagcccgccggggccgggtcaggcaggcaggccgacatcggcgtggatccggtcaaaatccccgacggacggcctgccagccgtccacgcgctccatcggacggccgccgccgcccacacataccctcctccgccgcctgctttatttagcctagcttctcccgcgagctgctcctcctccaccwcctcctcctcttcttccctccactcgcctccaaatcttctctctcctttcctcctctcttctcaccgcatcacctctccctccggcgcgcgcgtccgggtacagcgctagagtcactcaccacc

SEQ ID NO: 11854 - DNA, 501 bp, Zea mays
acataacataagtgacctacctactatgttgaaatagaccaacgatattaggtgaattgacggttgacgcgaccataacgtttgaccatgccaatgagattaatgtggccaaacgagttagttttagggctagtttgacaactctattttcttcagggattctaattttctaggctagtttgacaacttcattttctaagtgattcttattttcttaagggaaaatgaactaatttctcttcagaaaataaaatccctttgaaaaagtgtggttaccaaactagtacgaaaataaaataatttcttttggtaaaatgaaagttcctcgaacaaatgagaaaaaaatctgtgctatttttatttattttagaaaactctttgagctttaagcctttgacaactgcacgggttcaaagttcaaactcacaaaagagggcgacgccgaaaacggttcttctccagtctccaccggaggcgggaggcgtagggtttaggcgcgga

SEQ ID NO: 11855 - DNA, 1229 bp, Zea mays
aaaattctttaaacctagtttgagtattttatgaataagtgagattgaagtggattaagatgtattaaggagaaatttgatctattagggatttaaacacacttcgatttctctaaaacactccaatcccaaaatatccaacctaggccttataagttttcaattccatctaatttatatggaatggaaataaccaaataaagacttacgtagttgttgcataagatgatcgtccaaattacctgtacatttttgtctgataagccattgagacttttatagcttcgtttatttttaaaaactcatatcatataaaataaataaatcttagataaaatacaactttttacacatgagcacactccctatttctgatttccaagcaatacaactagcaatcaagagaacagccacgagaacgtagactgttacgctctgccgccatgaacctttaaatctagtgtccttcctacattttacaatcgcatatgctttattttctctcgttaacatagagttttccaaatcttcgtgaaggtctgaactttagtgatcrtataaatgaacctataaaaggagtgtaatatgtaccctcattaaggatccacagtcacaaactaatacaaagatagaggtgggaaaaccttttttaaaataacatattttaaatcaactcttacaactattcttcatgtttttaaaaagatccacctatattttatattggtttacacggtttacattggttacaaagtctaataaaagcaaagattttctgccctctttaataaattgttcattttggattaaagttagatgtttaaactgttaaagttataatttatagaaataaaaatactgtagaagtagtataattcgatacggatcagacaaacgaacatagtgaactgctggcggagggatgggcagggaaacagtggcaagtgggtgtgtgctttgtgctaacatggtgacgtaacataaaccccgaacaagtgcgtctctagccagtgaagaaacgtatcccttctccattctctgtgtgtaggcccagcgtgtcagacactgaggctgttgcagccgtgattcccgagtcccgacgactcgcgcggtcgcgcccctcgccttctccgctggtcgactggtccggctggtcttccccctcggcatcgcactcgcacctcccaagcgtgcctgaatctcagacttgtccccccactgcttcggcc

SEQ ID NO: 11856 - DNA, 351 bp, Zea mays
attcacaaatagacaagctctgcagacttgacaatcaaagatagaaattcagaaggcatatgatgaagggaaggatgcaaaagtaaaggtattggataggtcaattgaagaactcgataacgtgtatgtgttttagaatgcaaagtaagttgtgttccttcgtttatttagaagttagttaatttaataaaccttgctgcaagacaaatatatgttacagtaattgttccaagataactgaagaggcattggagatccaagtattacctttaatttaataaacctgatttagtagcaaggcttgccatcatcaatcaaaggtgctataacattttcacaaatacatctgac

SEQ ID NO: 11857 - DNA, 58 bp, Zea mays
gggagatctcaggtcgccaaatcgggtgtgtcacactgcccacctcgcgacaaaaacc

SEQ ID NO: 11858 - DNA, 1500 bp, Zea mays
catatggatatgtatggatacaatatatatatagcaattagttttattgtctatcccaattaagaatggccacaatgtagcatttgattgccatacacctctaatctatcctacataagcaagaatatgttaatacagcggcagtttgttacattacctgaatttatttattaaaatggccattaaaaagggtgttttgttacctatatgaacacatattgcactatatacaaattgaactgtgaaccatgaaatcattgaaaggatgttttcgtattagaaaaggttagctggtttactttcagaaatgaatttatcagtgaggcaactattagatacctttttaaaaaatatataacattttagttcacttttaaaaagggattaaaacatcataccaaggtaaaataaccaactttagtcgctgcagcattgttttgatgtaaaaaaaagaggttagtattacaggctccttccttgaacactaaatcctataagtacttcgatgccctatatgtcattcctccaattgcagtcagtacatagtttacctcctttattataatatataaatttaacaatgcattttatagcttctttcttcgatatttagaagctcaaaaaaagtgttcaactgtgtaggaacagtgagatcaatgattcaatgcctgcacctagatatgacatgtggtgattttgttgactgtactttaaaytcaagttttgaacaactcattaaactcaaattgtgaacaactcattgtaacacataactgttgtcttttctacaatgttcactattatcttgtgtatggtttctattatgctcctagaaccttcattgcagccgtcgagttttttttgcatgtgtatatatatgtccgaacctcgtggtgcaaaaaaacatgaaaaatgttgaaaaacaggtattatgctggtaaaggcatatgtggttgcagacatgttcaactaatatccttttttcacatatttgccaatgatccgattattgtttttaaactttctttaccatgaagattactaattgtatattgttataattcaagtttagttatattccttcttcatataaaagtatcctacaataaaaaattgtgcgcgctctggcgtgcgccaaccaccagtatatatataaagtgaaggggtaaatagcgttagtcagaaaaagacaacattgtattggtcacaacattatataacatgttttgtaacgatagcgttagtgcagaaaaaggtacgcatctgaaacggacgtgccagcaaaaaccgccacgtgctgaaccgcctgccgcaccgcactagcgtccgcaacagcaggagacgtcctcgctttccacctgcacagagcgccagggccgtagcgtgccgatcgctcgatcccaccaactgaggccactgtctagttgccgactctcctcgcaggccgcaatctcgcagacacgcaccgtcgcggtatccgtatcgccagagtcctcacgg

SEQ ID NO: 11859 - DNA, 1500 bp, Zea mays
tctcgagccagcagcctagcacgcgtgccaacatctcgagagagagtcaaatcgtttcttaatcgagaaaccataatctagagacggtttaccagtttggaggggtacgtgatggaggacatcttgtgcttcagcctgacctgacaccaccgaacgttcaaagaggacgatccatgaaatgatgctttagacgctgcccgctcgtcgtttcacctgtgaccagctgtacgagcagagcaacgacgatgagcgagccattgtacccaaaaaaataaaaaaactaatgtcagccgaggaccaggacccctgcaggttcacaggaaaaagaaaaactctgctctcaggcagaggcagaggcagccgctggctcgagcagctctagagggacgagggccgcccctttcctctctgtgcggctgtgtgcgcgcagtaaactagtaagatcctttttcctgtgcccccgataatggctggcacaaaaggggggatggagtcctctgtgccaatgataaagggtggcagaaaggctagtgcttttcgcgtcaggatagcaggaaggaggaaaatttgtggaagaaaccagatggcgactttgccaagatgcccccgttttctcaatagtataatcagccacttgaatttcaaggatacaccagcagtattaggaccgaaaggtgaaatttcattgtaaatatgacaaaaccgatcgtattcgaacaacacaaagccggtcatattcaaacaacacaggtttatgttatgcattaggccgttcgttgtcccaaatccatgagggttgagggggaataagtccactgctagtcaaaacccatctcaatccacttcaataccccttaatccacatggtttagatataaaacgaacaagaccttactgaacaagaccttactgacttccagtgttcagcccagtgaaggtaaaatatgtcagttacatgtgtgccttacagtttagtcaccattctaaactttagggactaaactttagtcactagaatttctatttgaaagacctaatttagtcataccgtttagtgttttagtaactaaaagtgattaaactttagtcactaaagtttaggaggtgggaaccaaacacccccttaatcaagcaatgttgaaagacaaagcataagtaaagcatttgtcacccaaaccacgcacaaccacttgttccaccatgcccctcatactattttctatcccgttttccccgtcgtatgcactacccctaccctattcttgtctagtccacgtcctacaattttcccttttctctgaccaccattgctcccaaatatgatgtcttctatcgtctatacgcttgtttctcctccatattgtcgtatgaattatgcgatcacgaaagggaggggatactgggtagcaattggtgtggagaggaaaggttcaagttgattttaaccaaggcagcacgacggcagcgacgacgacatacaacaacacgacggtaggggtg

SEQ ID NO: 11860 - DNA, 884 bp, Zea mays
tagaaatgaaaaaccgagaacttcggtttcggttttttactaaaaaaccgaataccaaacttatactcaaaacaacacatacaacaagtttatatgatagattacacataattttaaaaagtaaaaattatataggtacaaatatttagagatacatcatacatcacatataaataagtgaataacaatttaattgcttcacacatttagttcacataatcgaaaagtcaaattttagaattgataaagtttggtattcggttttttggtatttcggttcggtatacggtgaaaaccgattacgataccgaaaaccgaacttctgagatacaaaaaccgaaaccgaaccgaactaccgaaaaaaccaaaatttcagttcggttcggtacggttcggttcggttttcggtttatggtaaaaaagtgcccgcccctagatggtgtgctcccaagggtgtcttgcgcttctaaaatcatgtctcgagaatcagggcagccggcagagaccaagtcatcaccatcgttcatcagtcaccgtgtaataagtttatttattatagaagctttggatgataagacacggcgcggacggtgcatccgatgcatgcatatatatcgttagcctgagaagaaatcgcatatactgagtgctggccatgtttgagacggcaaaacgctgccgacgtcgacgccaaatgctcagcatgtatattgtaatcccactggccactgtatactctatatagcagacctctcgcaagcatcacccgccggacggacgaactcggagcttccagcaacctcagctcatagccgcattcgcctctgcagcgggagcgcacaagaacgcaggctcccacggcccacgtgtcctgctttcgacag

SEQ ID NO: 11861 - DNA, 1500 bp, Zea mays
gatataaaggattttcatgtgagataaatttgcaaagtttctttttacctgttgatttattgatctttgctgtagttttttaagaagtagcatgtactatgctttcattcagttgttaatctgtctcatttagcctatataaactcaagcaaaaagcgagcatatgcatcaaatcaaggatttggacatgtatggttaagttcgaccacaagaaatccaacactctaatcattagaatcgataatccaattataataaccgtacccaaccctgatttaaacaggcccttccttattttcccaagatgcggcaagcaacgaagactagttttctcttctggtagtcaagcatcatttgctacgaatatctcaattactgtccgacgtatcggatgacagaggtctttgacggtgcatcggctgtgttcacctggccgtcaaagaacatcaacagatcaatcaactttttcctgaattaaccagaatcccaagcttcaaagcagcaaaccgcctcagcgttactcgaatggtaagtacacagcgtgcggccagcgctcccattcagatcgaccgacgcaaagcaccagtcaaagacccgaacaagtaaagttcaacgcagactttctgctcccagactctccaacacgttcacacagccaaacgaagacaacggctcatggagcgcacggttccacacctgaaagcgctgccgtgcatgcacaccatcgtccacagcccacgccccacagtgtactgctatgctacagatcctactcttggagccaaccgagacccaacggcgccattgtagaccaggaaaagctcgcagcatccatctggcggtctgcccgtttagacgattattgcttattggagcaggagcgttcgatgatggagagcgagcagcagggcacggcatgcagacctctctccttccccgctgctgcagcagcagcaatgcacaagggaaacagaggaggggaacaggcaggaaaaaaggtgacagacaaacagaggcgcaatcatggccaccccgcacggcgattcccacccacaggaacggaacaagcgcaagcgtccacggccccatatccttggactctcccacgcccccttattctctcacctgcacgcctcccacttcctttctcgggcgacgtgacattccctccctactactactactcccaggtcctctctcatagcagcagtagagacgtggagtagtgtttcttggtttccaatcagcccataacatcctgtgccatagcattagcatcacataatggaagatggaagaattggcgcaacttgcaagacgaccacaagacgacgccctgcgccgtgacaaaactttgcagcttataagtaggcgcatgcccaagaccaccaccacctcaagcagcaaaaccccacacagcgagcgagcgaagtagacagacgctggctgagatacacacacacacacacatcaactgaaaacgaggagtttttgttcatc

SEQ ID NO: 11862 - DNA, 858 bp, Zea mays
caacggtcggcttcgccagaaaaggaaggatatcgtgcattgttccctgtccggtggtgcaccgggctgccccgtgtgcccacggacagaaggcaactattgccttccaaatggagctccaacggctcctagctgccttggggctataaaagggacccctaggcgcatggagcagtacaccaagcacctcttgaacatcctaagacgtttagactctgcaagcacgcatttgattcattgtgtttgagattggagcacttgtttgagctgtgaacttgctacgctgtgttttgtgctcgattcttgacttgtgtgtgtgtcgttgctgcgactctagctcttgtgtgcgtttcttttccctcccttactcttgtggtttaattgcgatcaatcttgtaagggtgagagactccaacttgtggagattcctcacaaagggataaacttgagataaaaagaaccgtggtattcaaattgatctttggatcacttgaaaggggttgagtgcaaccctcgtccattgggacaccacaacgtggactaggcaattgctctacttgggcgaaccatgggataaaaatcgttgtgtcacttgtttttattcttgtgcgattctctctacttctattcacttcataattgctctaagtttaataatcatcttgtgaagagcaaataagtgaagaagttgtctgtactcattctcctctctcgtatttggcattagctttcactaatctaatattagtccaagtttattttgttaagctgtttttacaagatctattcaccccctctaggtgctctcaattggtatcagagtcgtactcttcattcagggtctaaccgcacgaagag

SEQ ID NO: 11863 - DNA, 161 bp, Zea mays
acttccatttgtttctgctgctttggagcaactggaagagaaagacgaaatattggattgattacagaaattatggtggtagtcctccatcaaaagatagcttctctcctggatctagtttcaagtctaggaactcttttgatgtgaatacttctcagcag

SEQ ID NO: 11864 - DNA, 1500 bp, Zea mays
aagctgataaggtaaagtatacaaccaaagataacaatataaatacgagactttaatgagatagaaaagcgaactcttgttaatgcgccgatacttttactgtggtatcagtgtagcttcttaggccattctaagtggaagtttcattatagtttcgttctcattaaatgagatgacacattactatatttgatgacatgatacaatatttatgatgaaagagattgagagagtttcatgagaggagagatgatttcaaccagataaaactcgaatattatacagtttcatagacaaaagctgatgtgtcacttttgaaaaccgtgcaataaaactttcactgaaaatgaccttactaatccttgttataagctccacacaagtgtgcgtagcctactagaggagaccgtagtttgatactaagttagaaccatatgaatagtagatcattagaaaacttgggctcatactttgtctttcccgctagttagactattttaaccatcagaatattgagatctatgcattgaccgcatgcatgcacgtggaggaaatatgtggtggggcttattttagcaactacgcgcacagtgcaaatagcgagcgaagcgtcggtgatcccttagagcatcttaagatactatttatttttggctctctatttaaattaattctatatttagctttttcataaagattacactatatatgtagcatttcacttcaacagactatctatctaattttgttagtcaggtgactagacaaatttggctaatgagagagtcaatttggagagtcagatagcttaacaaatcagatagctaatctgttggagaattattttgctgttgagcagccaaaatttagcttgagaagccatttaactagtctcttgaagatgctcttacaattgcctcgggagaagaaggaaggacccatcgattttcggtgcatggcttcaatttggcagcccacttgcccatcgacggaatccacaaatcagcactactttgagacagtgttccggaaatggtactcgttttcaagcaattcaaagaacaacatcagtttcatcaattgaattcagaaaacaacacttcatctatatcttttcatttttttatttctcggctcataagaaaatggactaaattgcccctatcatttcccagcattatttattttatctattgaggccataaaaacaacataaatacatacaaatatatgagtactatttttatattattaagaatagtgttaaacatacaaataagcatagatgttctgtaaaagagaaagtttagatttaacaactgaacttcaaaactatattctaggatgttagagtaatttcatgctaaataagtaaatattcctaatttgagtcgagtaggatagcgttggctgcctataagtaccagctgcttgcggcacgaggaagaaggcacacacacttagacttagctatagtagctactactgtagtagatatat

SEQ ID NO: 11865 - DNA, 169 bp, Zea mays
atcgctgctgctacagtgtacttacatccgatccggccgctatcatatcgtcgtcgtcgtcgaataattaagcagatcaacatgtttgtttatttgcttattagtttctattccgcagtccgcactagctagctagctgctgtagtacctctcgtaatacaatgcatgc

SEQ ID NO: 11866 - DNA, 443 bp, Zea mays
gcacgtcatgtgagtgagccctatttcgcagcatgccactgccatctgattgagacacatcttccctcatttttctgtgggcgtgtctaggtttcagtaggaaataaaaacccaagctgatccgctgaacatttctggccctcaccacaacggcacaaccggcaccggcatgtgccagacactcggctggcccccaatcagaatctcatccaaatcgttcccgcagacgcgtcttgcaacaccacacccgccgcgctcgtggccatgtcccttgcccaaccatttcattccagcaccggactgagctatatatattcagggtcaggtgggctctgaacatcatcacttgcagcttcacaagcaaactaaaacacagcagctaaaggcacagctctccagcattcatccagaaagaagagaaggaaccaagccaacagccaacc

SEQ ID NO: 11867 - DNA, 472 bp, Zea mays
aataaaaaaaagacggagggagtatcagtttggagcatgcagcttcagacgaccgaaaaccccatatgcaagtacaccgccaggtcagtgagccccaagccacggcactgacggcagtcggcagcagcggctcggtcagggccacggcccacgccactagccgatcgacggcgctcgccgggtgaaaaaactgcatatattttgatatttttatagttttttcaatagattctaaggccaactgcctcctccgagcaggtcgctcggtctcgctctcgccgcgcgctgcgcgtatgcgctttccctatatttcggcgccgcgcgccccctcttccctccgccgccgcaccgcgcctcgccaaaaaaaaaaaaacgttcacagccgtcttccccctcgctcgtctccaaacgaggtcgcttcactcctccaaagtccaaacccggggcattatcgcgcgtgaggtagggcgag

SEQ ID NO: 11868 - DNA, 607 bp, Zea mays
gacatcttagttatcacttctgtaacttgaggtttttaggatagcgtcgtgtttctgaaattgtctgaatcctttaggccttgttcgtttctgtcggatcggtgggtcggaacgaatcctaaccggattgcttctctaatttatataaactttgattgagtggaacgattccgggtgcaatccgacacaaacgaacaagctcttaggctgaccagccggtgcgaggcggaacgaggtactttaaccgcgctatatatatatatgaccaactttcgaaataaataaatagggacgttatttttagaaataatttttaaaaggttaaaaatataaaaaagaatcttcagtggctgagaccgaaagaaagccggagcccctgcacggctccacgcattcgcacgcgggcagacgaggcgagacggctgcgtggtgggccccacgtgcagcctcacgagccgcgtcatgtccccagatggggcttcgggcttcggctattacctggcgcggagaggagagggagtgagtcgagatccattcccaactgcacctgcgcgcctcgactggtagcccgaaccctagctagcaggtcggaggcgagagagcagcc

SEQ ID NO: 11869 - DNA, 1500 bp, Zea mays
cagcctgcgatgtcgctggaccacggccacggccacggcccacgagggggcccccctctcacgcgtttcgttccatttcatcagtggcctgtgatcacgacgacgagcgccaaagtagagtgaccgtgctgtagcagatttcgaggtactaccagaatcattcccgcaatcaagctgttgttgttgttgttgtttttctcggrtctccttccgttgacatcatcatgagcgacgagacctgatgctggtatagtatagtcggaggagagctagctcggtcagtgcgtcaactatttactacagcacttctttatctgaagaaaccacgttatcaattttagaaagctgctttccggccccggatgcgcacaatcaaattccaggtcgatacggccggccatgcgcagagagtattgcctgcaggctgcagctagcatcagcaagagctgacgtcgaggcaggcaaacccagccatggaaatgatccatcgagtggtatttctgtgagcaagttgagcgaaagctacgtttggccgtacgaggcgtcgaatgatccatcgagggaactggtcgttctatacattttatcaacagtgaaaatgcatccacagtcatcgaatttagcattgatgtgttacttgctgggtttccaaactcttaaaacaagaaaaaaacatatactgattactgaaacttgcctaactcatcgtccaaaatcgggtttgagtacgcacgtcggtggtatttgaattcttgaacgggtcaaacccggttttagatgggttacggtcaaacctggtttttgaaaaaaaaatccatataacacagcatgctaaatactcattttcttattatacagtacttattaataccacaaagagtttcagccacgtcgtctgtcagagctggaaatttccattcttccgatcgatttgtttagcggtgactgcgagcgtattttttttttttaaattatagagacagagaaaaagaagagctcagaatacgtcttcctacgtggcgcctacgtgggcgtacgcgacatccagcggagctagaagttctcctggccggctggcccgtggccccccgggggggctgcgccgctacgcgcacccggcgacgcccacacgaaatccccccccgcttcccctctatttatttatttgtacacaccaatacggcgatataaaacaggcgcagcgcaggagtaccctgycttcagcggctcagccccttctcctctcccaccccgcgcctcgcctcgccggagctcggccgccgcctccgccgccgctgtccggttccgcagcagcagacaccgacgcgtccgcacatccgtggaatgccctcagatacgccgccccgcgctgcgtcttcctgagggctgaggccgagaggctccgacgccgccgaaggccgaacccgtgcgtcccacgggtccggaggagggagagggaggagcggctgctcggcggccgccgaggaggagactaggggg

SEQ ID NO: 11870 - DNA, 1209 bp, Zea mays
cgtgcgcgaggagaaatagaaagaagggtaacgggatgtagacgacgtgagtattactagtttaatcataaacgttaccaagtaatagagcgttcttgttcgttttggcgagtggtctattctctgtttttccatatcagctaatccctctcctacgcctctaaatcgtcgaagccgcacctgaagacttccataatagcaaatttctcctccccctacggctccgacagaacgacagctcggcccattcgcggtagccggcccagctccagaatctctgacccagaatggaacaagaaatccctcaacacttatgtaaagattgttccttccaaaggagacttgggcaattatacaaaactgctgtggtattccccatattcagagtatacaccaaaataggcccattcaggcagtcacaggtctgtttggttcaacatttttctaacagttttttctaacacttatgtataacgattgttacgcgggagaaaaataaatatatacataagattcaagatctagaaaataatcgattcctactattacaacaactcggtcgattttatgttcatgttattctttatggttttaataaaatcgaattttatagaaatggactgaaaaactgattgtttggcggtccgcagcatcttttggttccagaagttgaaaaaagctgaaacaaacaggaactttgactgcctgttataatctatggtggcacatctggaaggggcgcaatagaagaatccgtcttacagtttatcatgccgtggtaaaacagtcccccccccccaccccccacccacccccagtttaccatgcctttgttcgtcgcaytgaaagcttgaccattattttcatgcaagtgattcaaagctgacagagcactctacacatgagcataagacacttgagtaaggatgcttcgtaatttttcttcaaggttttgttgttacaaaaaaaaaaaactataaaactcaaaccaaacagttctgtctattcgtctcagaatctctcagttgactaccgagcactttgagttgagctgcattaaattttcttcacttttcttggttcataatcaaagtactggtcatcaatcatcataagaacagcatgcagaacacattcagctaatcgccttgcagcagctcgatcgcttcctcctgtccgcctggaagtggaaggccacaaaccacagcc

SEQ ID NO: 11871 - DNA, 209 bp, Zea mays
agtgagttccatttagtcctgtaatttcatttgactgttatcatgctcggaagctcttgttcatagtttagagttgtccaattctttgcccaatcagtctgctccaggctgttcaatgtacatggccgtagtaatgttaccatctccgcatctcctgattagtttgagctctggtatatttgttcaacgtaccggggcgcagatatgtt

SEQ ID NO: 11872 - DNA, 613 bp, Zea mays
agcaattttcttatagaagttgactgaaaagctaaggtgtttgacgatctgcagcagattttggtggccaaaagctaaaaataacctaaacaaacagggccatagtgtactacatttagggctcgagtcgtttgatgaatttttataaaataggattattgttgaaaaggatgttttatagttctgaaccctatatttaaaataacgcatgtcattagtaaagtaaagcacacaccatcggcccagcccaactttgcatttgcagccttcctaattgctattgctagctgctaggttacgagaaggcagttagccaggagccagggcccaggaggccagaagccgcacacgcggtcacgcggaccgcggacgactgccgccgccgtcgtcgtcgattggctcgtgagtcctgctcgctgctccttcctacgccgtgccaccgcctgctgtttcgctcgctcgtgcttggctgctcctgactgcaccgcgccgccgccgccgcagttctgctctccatcccgacacatcgcgccgcttcaagctaaagtgccactgcgccaccatccatcccggcatctcgcgccgtttcagtctcaagagcagatacgcaggt

SEQ ID NO: 11873 - DNA, 243 bp, Zea mays
gggtggtggcgatctcccagctgaactgaaagagcaagcgtgcgtgtgagacaaccaggtccgatccgcccccgccgagccgaggacagcagcgggggctctcggtctcctcctaggctcctacagatctcgtaccccgtcacagatctcgcgccctctccatcccatgcccaccccccctcgtcggatctgaccactccgcccctcctcccgtctccgccgccggagctgatatccgcggtc

SEQ ID NO: 11874 - DNA, 217 bp, Zea mays
ggttagcattagtagaatatttttgggtagaaactgtagtcatttgatgtatctataagtcattgttgtttatttttgcttgattcggcactgtacaggctggtaatatccttattgatggtgctggggtagtgaagcttggagactttggtgtttctgcttgtatgtttgatagaggtgacaggcaaagatctaggaatacatttgtaggaacacc

SEQ ID NO: 11875 - DNA, 129 bp, Zea mays
taaagcttagcggcgaaggcgatccccaaagccaaagcgaggagataaaaactgagtgatcgcgatggcgttgctgaatgctggccctgccgccgcactggcctcctcgtcctcctcctctccccctcc

SEQ ID NO: 11876 - DNA, 1107 bp, Zea mays
tcagttatcgagcacatggtgaaagtaaaatggttagctcgactcaagaaccgttagtggaaacaccttttacactaacggtttccttaaaaccccgatagtgcaaatcaagcattttcactgctgactttcttaagaaatcatatttgtaccggcagggccttaataaaggtcccgcaacttcggaagagacgggtgggtggggcgctcccatgattaaaatctgttttgctatttattttaaaacatggtttatatttccaaaaaaaattgtattgggggttttcttaacttaggcgccaataaaatttgatttccacggcagctgccaccgtcgtcatcgctgaccaacccggctggtcgcctctctgctccatccatgcacgttaccactatgcagatgcagccgaaacaaacactggctagaaaggcagcccaacgggcctactgtcattcgctccggcatcctactggtggtcccagttgcaccggccgatgaccagttcatcatttttctcgacgaatttgtgcacagaatttactaaaaattcttcgcacgtrgcaaaaccggggaaaaatcgacaactagtcggggttttttttctgatagaatagtccctgctattcatccatgaaaaccaaacacgtacactacgtcaccgtcatggatggagccagtgaactgatgattttttccccaccccgcacgcaacagcatgggtgacaacaaccactcccgctgcggttgggcgagcacatctctacgcacttgacactcacgcaaacctaacgcatactagattaatcatcgccaccaactatcggcgacagaaacgatgggccccgcttctcttaatcacggtgcttgaattagtgcgcgcatagtagtgaaaaataatagtgaaaaataagcagtgcgtgttttggtgtggtggttggtgagccgtccggcccaataaaaacccctcgcaccacctcgtccctcttcgtcgcatcgcacgccatcagcagctagcgcgctcctcgagcccagcagagaaaggccggcctacccactctctctctctctctctccagtctccaccggcagcgctaatcgtaatagcc

SEQ ID NO: 11877 - DNA, 97 bp, Zea mays
cctcccctgcctcctcgtctcctcggtctcccctccctgtcttccagagacacagagcagggcgctcttcggtcggaggagaagcgcgaccacgacc

SEQ ID NO: 11878 - DNA, 64 bp, Zea mays
ataacacaattttgagtagtttgtagctatggcaaactttgaagatctcaagctttcatgaatc

SEQ ID NO: 11879 - DNA, 1500 bp, Zea mays
cacaaaaatgtgatagaaaatgcattgagggagatgggtattagatccatgtgactttacaatagtagtgactcgacctttttgatcaaagatcttgtgactaagtacatgggaaaaacaagttattggtaaactaatgagagtaatatgtaaccctctctaagtgaagatgcaatattgtaagggttgtgaggtgatgtaaggtaggttggcgaatgccttagtatgctctattggctttaacgcgcgaaggtacaatcctacatagtggtattgaaagaacatacctatatgagtttgtataatgttgtagtctatgagacttgggtaatatatagtaagctcatgaaaagacgagggaatatgacacatatgctccacaaatagggaaggctacaagcattcaagtactagtttgactttcggtgagactcattcacataaaacttgcaattcaaggcatactacattgtccaagttgtgggttggtgtatcttggagttctaggcggaagttcaacttaacagtctctattgaaacactagtatattaaatagtagtgaacagtggcgaaaactacagatgggcatttgagatctggtgggggattgttaggatttatgggctaggcccaattgagaaattcaaataaatcccaggaaaatctcgaaagcccatataaatgtatggctagggaatggtggaaccaatagcaccatattgctagttctagtggagtagagctagtttaaatatggaagccacacactcaccaagtcatggatgagaggagagagtgtggagagccacacgcgcgcgctcgctcgcctcgcctggccggggcggggcaagcgaagggcgcgggcgcacggcatgcgtgtgaatggttcgtcgaaatccggcccctcgccttgcaggggcacgccttccttttaccgtttgaatttttggttacttggctgttaagtttagaatcctaaccgatcgctataaaatctaaactgaacgcgagattttcgcgggcggataagatcgaaggtagctatctggtcgcggactcggccctataaaaggcgtctggcagccatcatccaaatcatcccagttttcgctttcgcctctcttcacaactgagtcgccttcagttcccttcatctcgaccgccgacgtgcatctgcgatcgggagagcaggtcttcggaacccttcgcccttcgagatcctgcaccgtgagagggcgaataaggtttttgggaagcatcctcacgcgactgctcgctgattccgctgatcatcaaccccgctgcttcgacatcaccgaccctactgattccggcctacgccatctatcagtatgtctaatcagtacgcatcatctgatttgactttttatttcagttcttctgatttggtcatgatttgtattcggagtttaatctggaaattgtctaattattcaacaatccaaaaaccttattatagacaatttcctagtttttct

SEQ ID NO: 11880 - DNA, 389 bp, Zea mays
cctggatgacaatgggaaaaaggttgacatcattccaactgtaacacattatgcctcacaagaattaaacaacatcacaagatctgaacatacatcccaaataagtacctggatgacattgggaaaaaggttgcctgctcatctaaaaatatctaagggcatgtgttttcaccacctggtagctgcgctagctcgatgaagtcacttgcttcactcggggattcaccaagatatgctacatcattatattagtttgaaccgtgcagagatcgaggagggttaaatgtgcaaaacaatttgcttcagatgcttatgtaatatcggtgaacattttccagctaagaaaacacgcaacagaaccactgtgtaggtagagaaataatttctta

SEQ ID NO: 11881 - DNA, 256 bp, Zea mays
cttaggtttgtagcctggtgataattcaggcatcctaatgtactgtaaaaccttttgtgtattattaggtatatgttcttaataatgctgcggactgacgagtttatgcaaagttaggataacattataacatgcatttcaaatagaggaatatgatgataatcttcaagcaaatgtcatggagtagcagggttatgttatctgcaagtgatatcttggacctcttggttgtgattaatggaccaatatctagaac

SEQ ID NO: 11882 - DNA, 1500 bp, Zea mays
ctaggtcgttagattagttagaaatggaaagcctatactgttcaaaacttgctaattttgttcctataaaattattttatcaaccttacctctttaaacatcaactaagttgacattttctcttatagatggtccgtaccattcaaaccactcggatcaacaccaacttcatccctccaccacgactagttcctgtctacccagtggtagtcgaggaaattcctgtggatctccctcgcattcgggtggagaacggagtcattctggaggacagctcggaggagtttctgcctacgcccaccccgttggcagaatcactagccttcgcagctggatcgtcagtttcagcaccgccagcaccagtagtccaagcccctgctcccgaaggcgacgacccagacgactctggtgacgatgatgaagacgacgaggaagaagaagaagatgaggaaaacctcaacgatgaagccaacgaagaacagtaggaccactacgtggggttatggcctgtcactgaacattacacctcaatgttcgagacagggtacttccctaacctgctgcaggatgttctgcacgcgttgggaacctacgtccgacccctgtacgagaccaggcgagtgtacgagcctcctcgagcttggtactacatcacttgcattcatgtcagggtaatggatgcaggtgatagagggttcaggactctgtcagcacatgagtctctggcgccgctatccacctatgctgcttcggtcagcgatgctgctaggcgaactctgtggtctctcagccacacctaccggcagtagctgcacaacacgaagtacaggcatcttcctctgcgtattcgtggagagaaccagaccagcattgttgcatgtggagcaaatgaagatcacctcaacaccttagctggtgtggtggcaggtcttaacatcgacctggatagtgctaccctggacctctctagggtacacttggagctggaggatgcacatgtaaggatcgcagccctggaagctcagcttgatggaaggaatcccccagaagttcaagtccccgctatggcgttatcccctccccgcaagaggatccactatggagaaccaggatccatcaccaggctgctttagattttaaatttatattgtaataagttagttttctcgttagacgaagaacacttttctactattacacttataataataacaaccatgtgatggtgttgtctgaaatgtttgatttggatttttgcttgagtgcaatggtcttatggaatgatggccataagagcataaaaaatataataaacttaaccttaaaaataagctattccccctagaatcttctctactcctcacttaccccggagtgcactttctaaccaaacaaatggtgaacactcgatgaggtcccaataatcatcagaaccagcatggtcagcagttgccaccaccaccacccaaccccatgatggatcaattcatcgcagcgcag

SEQ ID NO: 11883 - DNA, 145 bp, Zea mays
gtttgccactccccggccccgatgtcgatcgagcagatgtttctgatgcagactcaggcagttcaggccatcggtttttactctggtcgccattcagcagcagcagcagcagcagcaacagcagcaagcaccaccccagcctcag

SEQ ID NO: 11884 - DNA, 1500 bp, Zea mays
gatgcagccatgcattgcaggtggtgccgtggtggtgcaccggaggagaaaagagagagacacagcaagggaaaagggccgtgcgtgatccgccgacgggtccgcgggcggctccatcccggccgtccgcgtcggagatccggcggatgccgcccggtcaaacagagtccgttccgtccacgcagatggaccagagaggaggggatcctctgcggccacccgagacctgttcgctttcttttgctgcgctgtcactctctgacagcgtaaaggactcattcaggagcactgtgttgcgttgcgacctgcgttgctttgcacaattgcacttgaacgtgagtcagcgaggcatcgttttgaaatgggatgggagggccccaaacggcttgtgtaaaaaataaatgggcgttctcttctgcctcaggctctcagcatctacagaggcacgcttgtgtttaattattgagcaccgttcggtttcgggtatggcagcgtgtgagagctgctgctaggtgtgctggtgctagctagcctgctaccgcacccgcactgttgcatcgggagctgatttgagctgacatcgactgtgccatcaccatcacccatcagccgccgcatacactgctacagtactggcgtactgctactggccactgactatcctacgtggctacatgtacgctcgctcgtgtcgtgcattgcaattgcatatttgcattgcatgcttgagagtcggtttattagattaattcggttcagtctattttaggttttaaaatttcgagttattaaaaataataaacgaaattttcaaaataattttaagaaccgaactcgaataaactcacaatttcagtttggtctattcggtccaccgaatagactcgaatagtagagagactattatcttttgttaaaatatatataaataataattaattggaagtactattattacaataagtgactataaaaaatagcatactgagatatatatactatcgttaagatgatatcataatttttagctaataaactcataaaccatgtaataatatcatcgtatattaagagcttttttatatttcgagttattcggtctatttggattatagaggttaggaaccgaatctgaacctataacccgaaatatagtacatatagaaatcgagcttgaacccaaataggctcgattcgaatttgagtttcggttttaaaatgcttaccctaatttcatgtgaccaaaaatcccaaaacccattcggtccttggctccttgctgaggcagagcatgactgcagccagcagtactgtacggctattaaacaagcccagagctttgctggctggctggctggcttgccgctgctcctctcctctcctctcctcgctagctccccccaagcgagcacgccgcccaccacgatgccagcgcgcacgggagccggctgctccgcctccgcctcctctccgctcccgcaccactagcgcgggagcccg

SEQ ID NO: 11885 - DNA, 1500 bp, Zea mays
gattattgaagcataatccaatgctagcaccacttcctaacccgcgtgtttcctagggtaagaaacaaacaacttttgagtgtgaaagtaaaaatatttaaagagccgccggccattctttatggtttatatatgaaggccttttcaagggaaaaaattatgtacgcatcctccgtttcctcttcttctatttatcttttctagttgagccgtgcatatcaaaagtgaccaaagatttgatggagatagacccatgtggtagtttgtgtattacataagcagatcaggtccatagcttactagaattcgagtttaatattcttttatgaagaagggagtatcattgttaagataccgacacataagcgatcgagatgataataatattaagggggtgtttggttagagggactaaagattagtctctagtttttagtctcatttagtcctttttttgccaaacactaggactaaaatgatttagtctttagtccttcacataggtgctaaaagagactaaaagcccacatatgagtgtattccaatagcatttgagtctatttagtccctagaaccaaacaagtagggactaaagtttagtcctagaactaaagtttagtcctaagactaattgaaaccaaacattggccttagttttgtggatgacatgccagacaggacaacataacattccgtctgggattttccatttatttagggaaagtttggtaaccytattttcgagagagatttctatatttcttaaaaaaattaatttatttttctttgagaaaatagtaatcccttaggaaatattccttagcctggaaattctgtttgcttgttgcttagcgagaaacagagcccagcgtacgtaaacctggaaacttctttcgttaatgaacaattaagggcctgtttggtttgtggctaaatgtgccacattttacctaagtttagtcgttcgagttgaataactaaccttagataaaaaaattagacaaagtgtggcaactgaggtagtgaaccaaacatgcgttaaagcttccagtacggcagtacccgttgataatcgctgactgtcccgcataatggaaagagacaccattgcgttcgagccggtcgtagtcgtaccgctaccgccattttgttccaccttgccgggccacctggctgccaacccgtccccacctgtcggacacagaccggcacgcgtaaaatcgcaccagtcatagtcaactgaactggcagcgcggggacgcaaatgcaacgcaacaagcacacctgcaccgcatgagcagcacccgaaattccaaacccacttcgtcaagcaacaacaccggctaaaaattaaaggaggcagcgcgtagcagttggtcgccaccgtcacgtacacacgctcacgttggaggctggactccgcccccgtgctgctcttcgccttgcctttctccgccggagaccccgccgcctcagctgccacaggaggaggaggcaacc

SEQ ID NO: 11886 - DNA, 894 bp, Zea mays
agtatggcgagcagaacaactctcagtgtttgacgcctagatcggcgccaactacatgccttcccactttatttcaacgtgtcaatgcgtgcccagcttgtgtgtatgtgcgtgttgtgaaggctagctatatctttgtacgtgtgcagctgctaggctaagcttcatccatcgctgaaactgcaattatcaggtggcgtctacgtacttaactggtggtttggatgatggtaacatgtatacactcaagcaagctggatgagatgagatgagatgacatagattaacaagcaccgcctcgtctttaaaccgctccttttggtccgaaaagctgcgtctcacatacctttcctacgtcactttattgcgacaaagcaaaagtgacagggagaagggaaataaagaaaaatataatcgtgtgtgtgtatagcatacaaaagaagaacgatcgagtgagagaggaggatggggtatgcatgtatagagagtgagagagagagagaaagaaagtttccggaggaaagcgagggaaagttcacaaataaaggagtgaagcaaaaggaaacggaaaacaaaacaaaacaaacaaagcccagattcctctctccgaacagcgcctatgcttttttttttttttcagccccgcctcacctcttcttcttctgctggtatctatcgttgttgttcccttcgttctctctccatctatctccctcagattacttgcgaccagcgacgctctggctggcccctttgagattgacctggggcttccatacaccaagagtgcagcaagaggatagatagcatttgttgcagcgctctctaggtcgtctctctctctctctctctctctctctctagctagctagcgtcgtctcctccggtgaggtg

SEQ ID NO: 11887 - DNA, 216 bp, Zea mays
ctgcaggacttgaagtgtgcactgacagcgtccaaggctccctggaagatcgtcgtgggtcaccaccccatcagcagcgcctgcgggcatgggaacaacactgagctggaggagttgcttctcccggtcctcagggtatatatatgcatgctgttcgatctaacatgaagttaattgtcttctctcaagtcattaacatgatcgatcgatctatat

SEQ ID NO: 11888 - DNA, 583 bp, Zea mays
taccgatctacactatccattagctcagtgaaactaatcgacgcatgatccataaaattaacctaaggtcacaggagtcggcccattcccatccctgacggccggcctcacgcagtcacgcttgcgcggccgcggcgtctcagactcccacctgtgtccaaatttgtaccttcttcatttttttttataaaaaaacgaaaaagatacgtccaaacttcacaacaaaaactgtgtccatccggatctcttcagggacaggaaaatcgcatccacgagacgaggcaacgagccatggagatcggcactgacacgcgccaacaacccctggatctcgccaggtcccgcgtgccagtgcaagttgcgagatcgatggatggatcggagccaacggggcagccggagccggcaccaagtacaatgctatcggccgcgctgcacgcggccgcggtctgccgtcgccatctgccgggctctcttcttaactcgctatcgacaacgcatcgaacagtcccgcgcgcacactcgcacgcactcgacgctcattcactgagccatttactcagatcaccaactccagatctca

SEQ ID NO: 11889 - DNA, 148 bp, Zea mays
gattcagtggctatcaatttctgtgaatcagatctttcttggcctcccatcttcgccttaggcagctgggaatggttttatactcgctgatgacatcaagtcttaggtgcttccattgatcaataactcagggaaatatggagggatc

SEQ ID NO: 11890 - DNA, 870 bp, Zea mays
ctagagtatgacaacatgttatcccatctctgatgttaaatctactccctgcatcctcattgatggcacaaagttgcaatacagaacatgacagggcttatgagagagagagagagagagaaatttatcctgacacacatgtatggttcacatttggttgtcttcttaaaacaagacgcgacaagatattttttttacataatctacaactcacagttatttcaaccaaatagccttcatccttatttcagttcacagcagctttctcataactcaaatcagattttagggaatcttagggaatacgaaacaggcattagtactacaaactgatttacgtcgctttcagcaaattctggattgtgccacagcttgtcgctggctatttctgacaaatgcagcatagtttggaaccatgaatcccagtcctagcagcatagtttggaaccatgtgatctgcacgtcactgccatgtactacaagtcttgcgtaccgatctcggcatctctgaaatttccaaacgctgtcacttcagcctgttcgtttttttctagtcaaaaacacttgccgccggcaaattccgaccatgcgacaaattaagcataatttcagaaatagaggcctaccaaccaagcatctcggtttggttatttatccaaactccaaaactacgagaccctctcgcatctcggtatctctgaattttacacgcactagtggcaaatttccaaacgcagtcgcttgagcctgttacatttttcggccaagtccaaagacttcgtggccagccagagacttcgatcgatctacggcgattgcacctcacgtcggaagcagcaccggagctcgcgcgtccaggcgccggccacc

SEQ ID NO: 11891 - DNA, 408 bp, Zea mays
cggccggggcatggcatggcatgtcaaagcaaaacaaaatggcttatggaaaactggaagtgcctagtcagtccaacccaaagagcgatgacgacgcagggaacaaagcccacgacaaggcccaatacggcccaaacttctgccactggcaaagccctaccaacccaagcacctatattatgtccacccacgccgcctccctccgaaaccctagaagcctccaccctccagcgcctccaccttcctcgccgcctcactccctctggtacgtgccgtcggctccacctctggctcgcgcccttgcttgccgccgctgccgccgcgattggcgcctaacctcggtgtcgtgtttttcttttcttagcagaggtcgcagatccgtccggttagacgaagccgcccgcaccc

SEQ ID NO: 11892 - DNA, 497 bp, Zea mays
gttttttatattgagcctaccgtatgatgtcctatgcctacctaattgcctattcctacccacacgaacaatcgagccaatccaaaccaaactccccgcgacaaagcccgagacatgcacgcatgagaccggctgagccgatggattggagccgagagccgaggggagagggtcaaaaaggcaggagtagatcgctcatggccgcgatgatgagcgccccacgaggcagtcccttcgtcccttcccttccattaataattgcggtgcacaggagcggagatccacttcacccgcaccgcacagctcatgatttgcacagccaccctcgtccgtccccgcccagctgctagcgcaaggaagcagctggctggctccaatcccccgccaccccgcctatttataacaccaccacttcccttgccccctccgccgtcgccgccaccgccaccaccaccaccgttgccgagccctcgcctcaccctcacagtcgtctcagg

SEQ ID NO: 11893 - DNA, 258 bp, Zea mays
aaatcgcagagcgcacggcggccactgcccactggcctcctgaatcctacgctcgccaagtcatcattcgcgaccagctcccgtgatcctcagctcacctgagctccgcgtataaaaagcgcgagctgcagaacccaaccaacaaaagactccacttcgccaagtcacgctcacgcacgcgttttctcggtggacggtgggcacggacacggaggagccgccgcaagcgcagcgcagcagtgggcgcgaaagcaaggc

SEQ ID NO: 11894 - DNA, 463 bp, Zea mays
gttttttgttgtaacccatgtgaacagtaaatataaatatggcatgaagcattagtcttggtggatatttggtcccaaaaagttaatgataaacttctgcagacaccacagttaaatatagaacatatattggcaaatcaagaaatggaccccaagttagccttcaaaatttattttaaaaattccatcacttctactaggtttgatgaatcatagtaccactatcgatgtggttatacccatgatacaactatgtagcataatgttatcacatttcataatcctctacacggcaatgaaacacatattcggtgtactatactattcgtacttaccaaggctaattttactttgatagcatgggtttgcacggaatgtgaattggtctatcacagattcagaagtcacagaaggagatccagctgtaactttggaactgaaagatgacacttatagccgttct

SEQ ID NO: 11895 - DNA, 127 bp, Zea mays
tgttagaaccgtcgccacacttgttctttcgtttcccatttcccgcaacttggacgtggtaattctcacttctcgttcgccccccccttgtgcgcgtgctcgtgtcattgactaggtggggtttgag

SEQ ID NO: 11896 - DNA, 1500 bp, Zea mays
aaagtaaaattagtctagaatataaatgttgctaatatattctataaagctagttaaacataagaaagtttgatcggcacaaatataccataccgacaagcgacaaacattaactgcatccatgattggtcgatcgagtgtgaacatacaatgatacgggttagagagaatataataacggatgcacctgaaacggtatgatctcagcatacagctctgtgtactgtgtagatcaaagtcatcgagggcgccttaattattagtgtgtgaacatacaatgatacgggtcagagactcagagatcgagcacagcatatatacacaaaatcaatgcacgggcctaaaaaaatagtatgatatcagcatgacagcgtggacacacgtaacgaatgcaagtcgtccaatcaggccgcgcgcgcttcatttcatctcgtttcgcggtacgtcatacgtgaggtgagaaccgaaatcgacggacatgcatgtagagcaaggaactcatatcccaccgcggctgtgcaggtagcacgcgtacgcgcttctaaaaatcgcaccgcacgtgcgcgcgcgcgttcgatccaagtttctcaaactttctcgtgcgcagacgagacaagacgcagttacaccttggcaacgtacgtcatcgcgatcgcctcctccaccgaaaacatctcgattggacatcggtgatgggatagatcctcctcccgcgatgctggcgtggatcgatctcggagtcgtgcatgcaccgccgcaagaccgacgactactcttagcttgttgggttcgtacgcgacacagggctccctcctgctgactgcttcgtcctcatcgagctcctccgcagtgcagtgaataatgatgctcctccacaagtggtatagctagcatgcatgtcaacatctcctgcgcctctttcttccgggaaccttctcctcgcgcgcatccagctggtcgtcgatctcaccaactcaagaaaccgtcacaccggcgaccgtccatcctactgcctgccctgccaccacacagcagaaaattaattacaatactcgatcggaccggaacaaaacccgcatgtgcgccaattactccctccccaatcccagaaaaaacaccgcagattcccggaacctgcagcacgggccgggccaatccaccgccgcaggccgcagcagcactgaatctgctctcatctcagacagcaacaaaaagttgccacctcccctggaaaagggaaaaaagaaacaatctttgcggcgccagcgggcgcgcgcagcctatataaagctagcgcgggtaaatcccctcactccacaagtccagagacccggccagctgctttagtttgattccaattccaaccaacaaccatcagcagacagcagcttattaatttgattcggacatcgatcggttcatgctagctctgcggacggccgcgcgcacgtacgtacgtacgttcaacggatagctagctagctagctagctgagagacc

SEQ ID NO: 11897 - DNA, 1500 bp, Zea mays
aaatgccaatccctggcgcactcacaaccggtcaccacactgtcatcatctactgtgacggtgactcgcggccagacggctgtcggaaagccaggcaaggcaagcggcgaggcgacggccgagatctcgacgccgacttgacgggctcgagattgcctggcaccgccaccgcgtagatgccaaaaacttgccatgggtgttgcggtgacattgctgcggacacggacaggcgatcgcgacgcagcttcgctgcaggcgtgcggcgagcgccggcgaaatgatgacggcgcccccgccgccgccgccgacggccgtcgcttcggtggtttgattgatgaggtgaccgcgcggcgggtgagctagcaatagcacctccttcacacgccaaggcggcgccaccggtcatccacgcgcccgcgggtgccctgtgttttggtacgatgcacagtggttttggagaagccgcgagcaacttgcagcagcgaagttttccagatcagttgattgacgacagttcacgtacacatgcccgtacgccgagtacacgcacgaaggaggccggatggtgcggtgcagtagcggacggacctactccagctccagctccagctccaggaggagccatgaaagtatgcacggtttccaggggaccaaaatcatggccaccagttgggtttcggtctctctgacagcattattgggttctatgattaggagatcagcatacccccccgcccgcacttcgctttcctggggcatctgatccgagtgctcccaagcaagtcacggtcaccatctctggcaagggatgcattatccattgcgcatgtgtacttgtgcttcccggggttatgaacacaggtgtccttggcccaggcaccgaataaaaataatgcacccaaaaaaaaaacattttgaatcgaccgattgatgctactccatttctgttttttataatgaagaaacgttacagtacaagaatacgaggacaccaaattaatcttgcgttttcacaagcggagacgcacaacaccactagttggtccagtactccagttcgcacaccattgtccgcaccgcagtcgctttctcgccccacgctcagctcagatctccacggggcccacggccatagaccccacccttgtccttgtgaccttgtctcacgctactacctctgcctcaaaatagaaccatgatatattttttagttgtaaaacatcatatttcattattgtcctatttacagttttcataaaaaatgctatttattattttttattggggtttttttaattaaaggtactttaacgatatttattttattgttttctaaaaaaataaataagataaatgatttgttaaatctatataaaagtaaaaaaacggcaaccatctacgggagacgaccaccgcatccctctatataaacccacccctccgcccgtctctcggtcagtctcaggcgtttcgttcctcggcatctcaagcgcagcagcg

SEQ ID NO: 11898 - DNA, 745 bp, Zea mays
gggccgtgccggtccaggcccaagccaagcccatccttgtggactgtgctaaggctcggcggaccggaatttaaggctcagcctagacctgactttgtacatgctagattgacccatattatttcttgccggtcgtactttatgctcatacttttgggtggtgctggcccaaaaggcctggcacttattcccggcactacttgggattagtggttggtctcaccgtcaacaccaacagtccaacacaatagagtacggtcaccactcacatgtgttccgattgggccacttttgcagcctgcaaaaccttctcagcgactcagcgagcacggcacaccgcccgcccatcctgtcgttgggccgcaccggccggtttctacagcrttggtggagctcaagcgcgctggcgtcgcacgaaagtgaaaacgcccacatgctgccagtgatcctggccaaagccgcctcagccaatggcctcgcactatcatccaagacgtggatcaccaccactagcagcgccatccgcaccgtccatatccatccaacggacagcgtcccttccccaccggcgcctcccaaaatttttggcatcccgcgcttccaccaccatccgtgagtcacgatcagtacaaatatcccacctggaatgcccgatccagacacgcgaatcctccaatctgcccttgccgccgccgccgacggatccaggtctgtagactgctcactcctctacgctccgctccga

SEQ ID NO: 11899 - DNA, 1070 bp, Zea mays
agcgacgacgacaccgagagtgcattagctaggttatggtctttccatcgctagccgtattagagtagatcaggtccctaggtttatggggcgaggaatgttaaccaataatccaatgtattgttatgcatgcaatcataatacaagaagtcccctctttgaccggattcacataagatcaatccaacagagaggtggcctggacctgtgagctgcagtgttctaaactctgatctctagttcgtccgtctatcagtttacaggagaaaaactgttgaaattaaccgctgagcactccaatcctagccaagtgttaataaggtagcgttcgatctgacgcgacaaggaaatctcaacagacgacgcgacggttaatttgcggtcgttccttgagaagaacacacaagatcatatcacaacactgcagggggggcgggcgcgggcttcagtctgtaatacgtacgttggagataattggctggctgcatcatctcagtagtctcagtcatgagtcatgattcctgaatcctgacgagggtgcactcagatcgaacggttcaaaaaaaaaatgagcgcgctggacgccggagaaaatacatgtacgtccgtccagagcgagagcaagcagctagcggggccatacgtcaaaaagggcgattcctttgcctgcactctaaaatccaggcggacccaactctttgtacatgaccaggcaaaagcggccgctggctggcgctaataagccccgcctttttctccgtctcctgtcaacaccctttcgatcatcatcgtcacctaattctcgctccgccccggttttttcttgtcactgggaaaaaaagggaaaatatcatgtcgccacctaataaattgcaaggaaggaaggaaggaatgcaaccaccgtcgtcagtactgtactgtcctcctcctcctcgctatataacccttcattcctgccgcgtgttgtagctatagctctagctagctatcttgctgcggccggccatatataacaaccgtacgtcctcgatctctcgtccgagatcgatctgcgtgccaagggaagggag

SEQ ID NO: 11900 - DNA, 552 bp, Zea mays
ttttcctctgcggcctgcacagtgagagagaaaggttggcagtgagtgagtgagagagagagagagacgcagcggcagcttttgcacgcccgcggcgcatcttttatccccgcgagctagttcgtctcatgtgtggcctttttcccgggagggcggcgggcgaaatgtgatgatgagttctcgtggcgtccgtcgatctgttcgccattctcccatcatcatagttccctgtcgtcctttgcgcatttgttcttgtcctcgggggagcgaggcgtcggggctcgcgcgcttcacgtgttgattcctcgctcccgcacactgcctcctcgtcggatttcgtggtgcggatgccgctttttggacgcagctgatcagttgttgctttttgttccgttctagcgctcctgccttgtcccggttcttctctctctttctcgctcactgcctgtcttcaaaagtttcgaactttgaaatctcctgttactatgacgatgtgattacggaatatgacgagttattatgactctggatttgcaggaagggacggtgtga

SEQ ID NO: 11901 - DNA, 1500 bp, Zea mays
gttgcgttaattcctgtcaacacctgcatgattgcgctgcgtacgtgtggaccatacggtgctgcttctttggcttgtgagaggtcaggtgaaggggacctgttgctttgcttgggcaggctaacattggcctagctaaccctgtccccattacgagatcaagcgtaaataaatctgctaattaactaaagatgcatgcatgatacactaatagtttctgtcattcgatcttccgtgttgtagctttcgctctgctgctgatgccggtgctttcagagcagaggagacagttaactgtactccaaaagtctgaaccaaaacagttcagtttaatttttaatacacatgttatatgcgttgcgtagccacgcaacgcaaagaatgtttcacttcttcagaaccagaagcaaagagacttgtcaaaagtgttgcgtcataacgaggagcggcggaaaagtcatacgatgctgagaactttcacatctcatctgcgttaaaaatgtgtggtcctgacagcgcccctgagaaatatctgaccacgagtggacccccaagtgctcgctatatatgctgggttgcttcgaaggaggaggcaggcagcatgttttttattggtaatcgttccttgtaatccagattaaggaggtatataaagtggtctcgtaggcatacagcacgtacaacacatgtcaatattcagctgagctcttcgtctggggaaaaaacagctggcgctgtcgattagcatggaagatatccttatggtaaatcgctttgtgtattaaaaaaaatatgtgttggattggaaagcatttttccaactagcaaaaacgttggttcaacccttctttcttttagcaatcatttacaagaagcccacatcaatcaggcttccattccatccgattcgccatgtcagggtccgtgctgtccatgttttatgcacaaacctgctgaaagcgcgtctgaatataaaaacggagagcttttcgttttcagggaaagcgagcgagcatatgaaggagaactcccagaagaaaaaaaaatgggttcatttgcagctaaaattaagaaagagcttagattgcttgagttagattagttctccttttcctacttttttttttattgttttcgctcgcgctagtctgcgattatcaattcgccatcttgaaactgacagcaacagggaagagattttagagaagatttgtttcggactgggacgggatcatgtgaaaccggacaaggaatcatacggtttataagcaaaggagagtagatgcaggatggagtccgctacacgccactggggatcctataaattcccctgccttttcttctccactccactcatcacaaatctctctctctctctctacaagctccagctagactgtcctgctctgcttcggcgctactgtgcagtgtgcacagccagccagctctgcagcagagcagagtccggctgtgagccctgaccagagaggattcagtgcc

SEQ ID NO: 11902 - DNA, 62 bp, Zea mays
ggtaaagccgaaccacgtacagttcctcctgatgagtcatgaacagcagctggccggcaaca

SEQ ID NO: 11903 - DNA, 1500 bp, Zea mays
tttatgcttcaacatgtgtgtttgacttagatagagatttgagttcgatttacaaaaacaaaccaagtggtggcaaaggatgatccatatatgccaaaaatgaatcaaaataaatttgaggtttatttgaagtgattttgcacttgttctagttgctttgtgttgtgttggcataaatcaccaaaaagggggagattgaaagggaaatgtgcccttgggttttggtgattgagtgcaaacacaagtgcttaattgtgaatctatgcccatggatgaacaaggtgcaaatcacaagtaaaggtatgtttctaagccttagcacattggtgttatgtactaatatacttgtctaagtgttagaaacagaaagaagaagaaagaagaagagttggctgtgtacagccaaaagactgcttcggtctggggcaccggactgtccggtggtgcaccggacagtgtccggtggtgcaccggacagtgtccgatgcgccaggctgcctcgggcgaagaagccgctctcgggaatttgccgacggcgtacggctataattcaccggactgtccggtgtgcaccggactgtccggtgagccaacggtcggctgagccaacggtcggccgcgcgatctgcgcgggacacgtggcctggccaacggtcggaaggaggcaccggactgtccggtgtgcaccggactgtccggtgcgccagatctgcaacggttggcaacggtcggctgcgcctgttaaggaaagaaatcgggcaccggacagtgtccggtgtgcaccggactgtccggtgcgcccgacgacagaaggcaaggatggccttccagatttgttctcaacggctcctagctgccttggggctataaaagggacccctaggcgcatggaggaggaaaccaagcaaccttagagcaatcttgatcatccacactcagtctttgcgcatttgtttgtcattctaagtgattcgagctctgttctagtgagaacttcgagatagtcttttgagctcgattcttggcagtgtgtgtgcgcatttcgttgtggatttgtgtgtgttgcttccctcccttactccgtgcttctttgtgaaactctattgtaagggcgagagactccaagttgtggagattcctcgcaaacgggaaaagagcaaagaaaagaagaaaaccgtggtattcaagttgatcattggatcacttgagaggagttgagtgcaactctcgtccgttgggacgccacaacgtggagtaggcaagttttgtacttggccgaaccacgggataaccaccgtatcatctctgtgattgaattcttgtggttatcgtgttttgattcctctctagccacttggcattaactgtgctaacgcttaaacaagtttttgtggctataagcttaagttttacaggatcacctattcacccccccctctaggtgctctcaattggtatcagagccgttctcttcaagaaagggactaaccgcccgaagag

SEQ ID NO: 11904 - DNA, 526 bp, Zea mays
tatagattcttttgagacaaaagtcggtatggattaatgctaaaaccttggcttgtctggtctggtcgtctatttggtctatggcggggggctgttagcggctgctgcttttccagttcgcgctaccatcggtagatgtagaaaaacgtgattggatcaaaagttattctgaaaatatggtcttggaattgcgctaactattgttgccatgctcctggccatttaccgatttgctgatttgccttaggaaatgtcgcccggtcggtcggttccgtgtctcctcgacggcgttcctgatagcagctttcaacgggcattgcacaaggcggggcatttcttgtatcgcctgcctccaggctccagcatgctctctttctgctgagctccccggaccccgatcgcgactgcatcagagtagggataaaggagagagagagccagtgattgcgcagtgggcaccaacgcaacgcaccgttgcctgtgaagcagcgcagcgcggagcggaagggtccagcgaccgcgactg

SEQ ID NO: 11905 - DNA, 362 bp, Zea mays
gaaagattttcctgtgaaattcacttttgtatgcccaagaattaccgtggccatggcggcttcgaatcctcaacagccacctggatccaaaatccaaagccctccaaaagcaaagctcctcatcacccacccattgctcacatttaacaccccaccacctcaaaaactgcaagccgcaagcgcacgaccaccgtgtccaccacggcaccaccatcactcccacaccaccgcctccctctccgttctcttcctcccaacgactcaaaccgccaccgtcgcggctccctgaaccaccagcccagagcccaccaccaacgctgctgctgctgctggagagagaggggcgcgggtggacgggagag

SEQ ID NO: 11906 - DNA, 97 bp, Zea mays
gaaaatcaccctgagggttgcagcaagataccagatgctatctcttcaccatgtctgagagctgcaccgagctgcgggagctaatctttcaaactgc

SEQ ID NO: 11907 - DNA, 390 bp, Zea mays
tgtaatcaaagtaagagacaccaagttgtggtggtccttgcgtggtctaagtgacccgtttgattaaggagaaagctcactcggtctaagtgaccgttttgagagagggaaagggttgaaagagacccagtctttgtgaccacctcaacggggactaggttctttggaaccgaacctcggtaaaataaatcaccatgctatccactttattttcttagttgatttgttttcccctctctcccgaactttatattcgctctaatgctaaccccggcttgtagtgtgtgcttaagtttgtaaatttcagattcgccctattcacccccctctaggcgactttcaattggtatcggagcccggtgcttcattagagtctaacaactcgaagtg

SEQ ID NO: 11908 - DNA, 670 bp, Zea mays
agtgtcattttagttccattctagtgttcctaggtatagttatcttagatttatataaagaggtatagcatttatgatgcggaatagatataatttaaaatatgcttcatggtgaatctatctaaatatcagtatttttaatttaatttaaaattatttgtcttagtacgaaaactaaaaacagcacactttatgagatggaggtagtgagatatcgtatgcatttttttctgtcatcataaattcctctctgtgtgtagtttgaattttacaatgtggagtgcattacagacttacagtggagaaggttgtgggtaagataaaggtagggccgcttcgtgacaagatagattagcacgttaattagtcggaggtggcggcgaggagccatcggagatgggaaaagggtgagacgagatgagagtgagcggagcttggcacggcggggagctcgccgacgctgagagaagagcggacaggagagtcgtgaagatctagaaaagtcttattgtgtttgcttcttattttggttaggaattttatgactcaaagcatgagaaaagagtaaacatcgaactaaatttccaccccgatgagtagcacgactactaacataaatttgatcaaggtttgaccagttttctgagtggaaattaacagtggacagccc

SEQ ID NO: 11909 - DNA, 464 bp, Zea mays
ctcccgagagcgatccccgtcgcccctgtccgcggccgccgaggcgccgactcgccggcgcggcgccgtcttccgccactgcgccctaccgcccaggacgaagctccagctccggcccaccgtctccctgccggcactgccgcgccgagggcccgagctcctcctcgccccatgcccccgcggccgccctgcccagctccgccccgcgcgttcgcggctctgcgcccccgccaggccgagcttcgcacgttcgccgtccgcgccttcggcttccgcagttcgcacagctgacagcagtccattcaccgtccgcgcctccggtcaccgcacagtagtgagtgcattcgccgtccgtgcctccgatcaccatacaaccgtgaccgttagcagcaccttgattttagctcgtcctccgccactggtggcagcgacgcgcttccgaggaggttagagcattggctgct

SEQ ID NO: 11910 - DNA, 1368 bp, Zea mays
tgtacaattggctcaacacgatggtgaaccaagtctagaacctcgagagcaccaagtggatcaaccatgaagtcatccagcaagatgcatctacaacatcaacacttggtgacgacacgatggacatcgatgataaggacatcaatgatgactccacctcttaggtatcacttttcattgatgatatcgctattgaggcagacaagttgatggatgctttagttagttaggacaagttacttaggcttgcaacgcatgagaggaaagagtgcaaatgcaagtacgatgatgtgcttaaggagcttgagtttgctagatattatgtggtggtgcctaacgaggctaaatgtgatgagtgtgctcttcacatgccaaagattagcatattgcagaccaagtatgccaccctgctagatgagtgccatgagtaatgagttacaatatagatttatcttgtcgtgcgcgtgttagtcttgtcctagtttgcaaattaagctagtggaaaagaatgcaaggataacctcgcttaagaaggctagctcaataagtgcacatgtacctacttactatgcactatgtgatggtttgtagtccaagctcgagtcctaccaacacaacaagcctaggatcgaggaagaaaacacatagctttgaccagtattaagctagatgtctagtagtgcgccctagttgggaatgatagttagccagtttacgagaggaattggtagaccagggctagtctttgtttctaggaatgggaatgatgattattatgtgaaggttggtgaccatagtgtcttaacaccttcaaagaaatttatagccagttattaacctatcaatttcactccacccaactttgccactcaattatgagagagggggtgtttgaggaacctccaagagggccacctcaaaaacaagcgtgttgtccaagactaaccatcttaagaaccctcttgacatcttgcccgacatctctagtgatccccttcctagagcaccacatccacccaaggtggcccattcccacaaaagagtccacctaagagagaggtgatgtaccactatgaatattgtaagagggatggtcatttggtcgtatttggccttaggaagaagagagatgaccaacaaagttttgaggtgaatagtagggacatacaccactcttttgatggtgtgcatacttatccctaaaccctaaacaactcacttttggcccatgaaccgtttgtgtcaatggattggtttgataaaaaacttgagctaaggggtatgtgccaaaaaggtctcataattagttagtaataaaatcgaagttgaagttggagttcccaaagtttgaggagtcggtttcgattg

SEQ ID NO: 11911 - DNA, 564 bp, Zea mays
atgggctagacacacaacaatcattactaggggccatccctgggctttgtttattcattgttgttctgggagtgagtgcccaggaagatggtgaacagatagtaatatatatatataccggactgagaggtgagagccatgatttagcctggactatatacttatcagattgtgtatgggatactgatactcccaggagagagagaaaaggcatgggaaacaagcaagagaacaaaagcgatgggcacgcaggtgttaggaaagtgagaaaccatcagcagggcagcaatagttacaggcgtgtctgataaaagtcatgtgatggaccagcagcgcgcggcagcttgttcatgctgcagcgctggtagctagctgcttaaagtgagaaatactgacgacgacaacaaaagtagggctagaaaagctatatatacctggcgtgaaatctcactccagtcctctctcgatctaccttgatctttgatttcatttgtttctcaattctttgttaatttatatggctaatcgtacagtgttttgcaggtgagtgtcccggggaacagc

SEQ ID NO: 11912 - DNA, 1500 bp, Zea mays
caaacgtcaaataaaaaaattcgaataaaaaatttcggaggtgatatgtatatttactccctcaggatgctgcgagatattagattcattcgtaccaagtatcagttgcacaaacaggcaaaaaaaaaatcaacaggcgaccacacaaggatcattatccctgaaccaaaaaagcctgatgtcgggtttgacttttgttctcccatgcaaacttaattgtgtgctcacactcgtatcgtctgcactctgcactgcacccatcaattctttcctctgaacatggttccaatcttctagaacgatgttcagatcatatgctccgatccggtccagtcccgactaatgataattgaactgctagctaaccacgaaatgccgcgatcagagaatagtactccacctaatcgaggcatttacttttgggggttcaggaacaagacactgaggtcaaatttctgcacacgcaattccagctgtgacagactctttcaattcatcttggtacgtacttccaaaatgtttttcttgggttattatctgctgggcgagagatacattgtatgcatgcatgcataggtggcttatactatattacatgagactacttgtatggtgtcatccatgcaggaatatacatgttggcatgcttggcagatgatactgtactttaggtgtgctaccaagtaccaagctgatccaaaaaacaacaacatgcaatggctagttttcaaaacgagaaccatctaatacttggacagtctaagactctcatttatatgcgcaaagagttgtttgaatagacacatttttatatggaatatatagtaatagagcgcttccagaacctgtgtgctcgctcattttgtttggactttggagatggagcaacagcctacagccccaccagcaaaacgtctgtcagcagactcagatatatctctaattaagacatgctgagctgaactatttaatagcaatactatgagtaaacacatcacacacaaatgatgaaaacaacatatatactactaatataatgctaaaagaaaatagaggtgaccatatctcaacgtgcagtggctctgagttgcttggccaagtagcactgtgcctagcagcctagcaaagcacatccaagacaactagacaagtcaacaataaaggaccaggggacccctatatactttagcgtggggggggtggggcacggcagtggacactagtacactactaagacccctgcccccttttatgacggacgtgaacgccggcacactgaaatgatcaaggggcatattagtcatttacactcgtataaactatgtataacctgggttcaggaaacagggatttccaagtctttatatagcggaagctgtgttctggtgaccagccacccaagggacaggaagctccaagggccaagggaggctgcaggcaggttgtctccctccttcccacctgcaccacccctacccctgccccccatctcatccatca

SEQ ID NO: 11913 - DNA, 249 bp, Zea mays
tgcatgcctgcagcttgagcacaatgtttccttcgtactaggctactggcatatttaacacacttattcttctggatttgacataattgttcagttggctgaatcatttgttcttttttatcaatagttgacatttcttgtacagtattggtagtagtgtacaggttcgttgataatttattggtcattttcagtcttctggcaccacatatttcttatagcattgtctgggagatagcaaaactgtgg

SEQ ID NO: 11914 - DNA, 186 bp, Zea mays
tgcagcagcgtgacaaaccagaccttttcaatctcttgctagcttgctcgcccgcccttcttcttcatcattttccacacacgggctatccttctacctgccggttcgtttgtagttcttggagggagctagcagttctctgcgcgcctgagcgagccaccggttaatccaagtcattcattaccg

SEQ ID NO: 11915 - DNA, 49 bp, Zea mays
agccgcaggcttagggctagtttggtggatcgggaaatggagggaatct

SEQ ID NO: 11916 - DNA, 260 bp, Zea mays
ggctcttgctttgcttgctccgtcgccttgcaaagggaagtgggtgtggggctgctgctcctcgctccttcgacgctrcagggcggtgttgctgcaaatgcttactaaatgaagtgtattttattctgtcttcttcttttttctttcttcctctttttttttcttggtcgtccttcctcctttgccgggatatttagtaagtgtagtaatgaagcactaatactaatggatgaatctcgtgtgcaagatgttgatgagca

SEQ ID NO: 11917 - DNA, 1467 bp, Zea mays
cagcctttgtggttgtggatagatgaagccagctgaaaagaggagctgcagttcttttctctagatttgtatatatggctggctgttatgtacatgcatatacatcttcatctcaagtttgctttttggagggaagcttggacgtgccctacaagtttttttttgtaagttatgtcatcttacactagtacacaatagcatcagcctatcaacgcagaggacgtgtgacataattttatggtcccaaaataactgggcattttgctaatctagaacgacattattttggaatgaaatgagttgtatcagcatttgtaccttcaaattagtttagtttgaaagcataaatctgataggcctattgggcttccggttgcagcactgctgggcagttattctaccacaagggatgcagcagcagccatgacagcactgcatgtctccagcagcagtttacctgtttcttatctcatcttttattttaaactttattatatgaataatacatatatcttatctcaattttttattttaaactttattatgtgaacaatatggttgtagtgaaaacaatattttgcacaactatagtatttctatttcaaacttcattacgttaataatacagtttacaatgcaaaacaatatttgcgcaactatatgtatgatctgctgaagacagtaacatcacatcttttatttcaaacttcactaagtaaacattacaatctgcagtgtaagaaactgccgctgctaagtgtgcttctcttgtctctcagatcaatagcagcagcaggcgggcagctgctgcttactcatgcagccaaacactacactattattaggtaccattaacattatttttaaaataaacttacttagatttaaaatgatttaagtcatcaagaaacgagataagttgctttggaacggtgggacggaggagaaaacaacttggactccattcctgtccatattgagggcactgtcaagtgacatgatatccaaagcttgtgccaggcaggcatcgtgaccacatgagctgccaaaaccccatgatggcacggcacctgaggaatagccgcttctctgaactttcgataagaaaacaatttcagaaaagttccagttagtacaaaccattcggtcgtggtaaaagtaacatttgaaggaaacctcatcctctccccatttgagatattccctcgctcgctcagcagcaggaggcagcggctgctgtcaacaacaactggctgtccgacaccgcatttaagcttcaccctcccctcgggcctcctccactaaaactcggatagatctcagtgcagtgcttccctgttccctccatcaagaaacagcaaagatccagtgcagagagagagagaagcgccatggcactctgaacaagaaaagaaaagaaagagctagagaaagagagatctcagtcagccagtctctcacaacaca

SEQ ID NO: 11918 - DNA, 983 bp, Zea mays
gctgatagagcgttgcagagcttgcttgcttgtactagtcaacctcgccgcgggaacggagacttggtggtgtgtgtgtttttttataccatatggcagtggccgcccggtcgtttctgctgccccttgcgaagcgagcgcgccataacttccaagaactggggttcgagtggggcggaggttgcaacaagaggaaggagacgacgacgacgcggccgcctcggctcggaggagaaggagacacgatcacacgaggcgtaggcgacgaggaggaagcgtccaccaggggacgacgggaccctgtgcgaaaggtgacttcttggctgccttctccctctccctccctctacctgcctttttcgaccggggttcttctcacgtcacgggtagcttgattcagttgctgaatcgagcttcgacatgggagtttgcgccgcaagcgttagttctatagttgttctctgaaagtggtggtctttttgctgtatctgtgagacggtaccaaaatcaaaactgcttttggttgaagcagaacggtctgtgggaggctgagttctgcgggggggaaagctgaagataaattggtggcctcatgattcacgaacaagccataggcgttagggtaatcagtagcctttgacgactggattgagagattttcttatccttcttggccagcacccagcagttagtcttaattgctttgtcaacgaagatcaaattcccatgcttaagtccaacccagaccgctagcctgctctgttggtgagattctgaccgccgtttcctcttgcatatatttgcagttttacaggctgacagctgcggccgtcttctgctattgctgtctgaagctctgaactttgaaagacaactcttctcagcctcagcggcttggtgctgaactgctgactgcaggtaaccgcggccccgcctgggatttctgagctgtgggtggtgatgttctggtactctcttggttg

SEQ ID NO: 11919 - DNA, 741 bp, Zea mays
ccaaaagtcaaatacaagattgggacattcaacgttgtttgtagtcaccactcaccatattacatttgtttggccggccggtgaggtattataaggtacccattctcgtagcaccaataacgtgaacaataaatagtactgtaatcccaacaaggactgggatttttatctccctctgcgttacattgcattacatgaggaaaaaagaacaaaattagccaatatgatagaaggatcaatagtatcaaccatatttttactaacagagtaaatctgtataaaatgaggatggcaggggcggatggccggcaccatgcggcgggcgcggcgggaggttgttggcgacaaatgtggcggaggttgttgcgcgcggggacatgacccgtggtgagatagatgaagaaatgtgggagaacggttggagacgacgattttggatccaagcaaatccaggcacagaacgcgtcggcacgcgcgttgccgaattcgtggagtgcggactccgcgtgaatccctatccggtttcaatataagagatttaaatcttttttaacgaaccgagcagatccgcgccccaccttatatatatcaactggactcgaacgtcctgctctctgctctccccgcagacaaaaaaccctagaattcccagccgccgctctcctttccctcgatccgttcctccaagcgcgcacgcatcctcacgccagcgcaccgccgcccaacgatctacgagctgcc

SEQ ID NO: 11920 - DNA, 128 bp, Zea mays
ctgattttgtcctatgcaatctggtgctccacctggtgatcatgaatttcctcggataagcaactgctgcaccatgttggttaaaggttttgtagccccaggttgtggtcgctgattgttgcctttaa

SEQ ID NO: 11921 - DNA, 756 bp, Zea mays
ggggcattgtgggtagttccgggtaggtgtttgagccttgatgttggtggcccctacctatcttgggaactgtaacagtggggggtatttggtgcatgcaaacgcgacaagcaaaattcgggattatcaatcaatcatctgtgctactcgtgctctgttgatgatcttcttgttaaggcaaatgcgagaggaagttctggagtgccaataatctacggtgagcctgaaactaatactggcaccgttccatgaaaaaaataaaaaaatgaaaccaggaaggataaaaaacaatactagcaaatacggaacgagagaaactgcaacaaaaaaaaagtgaatcaaggaaagagagtgagggatagagagaaactgcaaaaaaaaaaaaaaaaaacacgtagagaaggaacgacggcccagcccaggaaacacgatacggtccagagtcgagaggaagagaaaaaccccgtccccctcggccgccgaagcgaaacagcctctggccgctgcccgaccccgacgccagctgcccagttcttcgccggcgacgagcactccaccaggtacgcccaccccttcccttcctccttgctgccgtgcgaaaccgatcacccgaaccctcactcgagctacttgcttacctccgcgtcttcggatctggtctgattgcgtcttcggatctgatctgatctgactatgacctgctcctttctggttatatcctcacctcacgtggagaagacgagaggggattccaag

SEQ ID NO: 11922 - DNA, 1500 bp, Zea mays
gcgacctgcaatcagtgatgactgtgagtgtgagtccggctccgtgcaacggtgcaccttcaaatagcgccctagtggcatgcggtgtctcttccatttctgtggaattcagtaagatgacaacctactattatattagatgttggtcccttctcctttttgacccccatcggtcacctctgaggcatgggcctagggccgaccctgccccatggcagtggcgtagctaagrgatatgggatatgccaggtatgttatgccatacacatgtatccagcatgtatatatatagagagtaaatgaaaaaatatctaaaattgttcaacatagaaaactattacactaattatcttgtagcttgtgatttttttgagtttaggtctatggccacaggacctatctaacgaattctttggatgacctgctaacatacaaaatcataaaattgacagtccaacattcggttacttagattttttaacggatgcgactcgtgagtcgcgagtgtgtgtagacttaagtcaagacatggattatgtatctttgaagatctctcggctaaaaaattagacaagtctccttttcataacctacactacattttataaactatcagtataactttccatctattttatattatagtttgtgaacatttttatcttagtttttaaatttaagacttattgttatttttaacttaaactttgaatataagacttattgtgtgtaatttagtgtatgttgaaattttaaaactattactgaattattaaatggtttaatggaaatagtttgatcagatgtatatgtaagttgtaaattttagttggcgtaccctacgccactgtgcctcatgcatgggtaacctacatccgatttgacatccacaaatagattgatcgatgcgccatgaaaagtgtctgcggratgaaaggtcttcaactctacacgctagcagtagtatttagtcttgagttcgattggcaaatagaagatccattcatcaaagccatttcaagctttgattctgaggccgtgcagctagctcattgtcgcaccatgaacaagctaggtcgctaatcaagaaagctgtcattctcccttcccttcttcagtacgcaggggaacgagcgaggtcgaacaagggatagggttagctcaccacccctgccgggctgccggctgccactacagattcagtttccacgtggcgggacgccagtggtcggataagggatagggttagcagctcatcactcctgaaacccaaggagcgccacacatgcctgagccatatcacgcctgcaggccccatgcatccatgcgtgcacaggatttcctcctaaagatcgatcgcagactttacttaggccgtcacaagcaggagaccctcctcagctagtacctaccggccagtagtcgtcgcgtctgcaggcagatctgagttagccggcggatccgatccgtgcgcgtgctgctgtgtgtgtgtcggtggag

SEQ ID NO: 11923 - DNA, 347 bp, Zea mays
tcttgaaaaatcgacacaaaaccaagcttgattttgcttggcaaagcgtagaggcggtttttagactccaacggtttgattaaccttgccgtagaccaacaaggataccgttggagccgccagattctcatccgacgcactaaaatagattcactgacgtgcaccccgacgctgacgtggcgaaggctactaccacaatatcgagcatcggcggggtcatctccgaaaaaaaacgcgaacgcagaacgccgccggcccgtcgtgcactcgtgtttcccttcctccacttgccttcgtgttcgtgattcgtgatttcgccgccggaaagccgagggagagggagcgat

SEQ ID NO: 11924 - DNA, 169 bp, Zea mays
ggtgcgtacgtacatcatgagtggcaaccacacgcagcactgctgccgccggtatgcatggtcgctgatggcgctgacgacgatgggatatatatgtgctatgcattgcaggctgagctacctgcacttcgaagaagggtgatgcaccgcgacgtgaaggcggagaaca

SEQ ID NO: 11925 - DNA, 481 bp, Zea mays
agtgatttgagagagagtttttgttcgtgttctttgtgctcttgtgcttggatcgctttcttccttcctcattcttgtttccaagggaattgtaatcaaagcaagagacaccaagtgtgtggtggtccttgtggggtctaagtgacccgtttgattaaggagaaagctcactcggtctaggtgaccgtttgagagagggaaagggttgaaagagactcggtctttgtgaccacctcaacggggactaggttctttagaaccgaacctcggcaaaataaatcaccatgtccatccgctttatttcttggttgatttgttttcccctctctcctggactcggatttaattctaacactaaccccggcttgcagtttgtgttttaaattataaatttcagtttatgcctattcaccctccctctaggcgactttcaattggtatcagagcctggtacttcattagagtttaacaactcaaagtg

SEQ ID NO: 11926 - DNA, 576 bp, Zea mays
caatatcctcatctctatagtaatgattctaaatacctaaatgtgtccttcctaggtactatttgacctttcaaactaacatcccttttctcatgtgtagtgccgaaatcacatctaatatacttcgttttagttctaccgagtctaaaaaccttggaattctagagtcttctgccacaactatattttcctatttactcctgaccaaaccaacttttattaattagcactacatcatctgcaaaaagcatacaccaagggatattcccttgtatgtctcttgtgagttgtgaccttatctatcaccaaggcaaaaaggtaagggattaaagctgatccttaccattgctagatattgagttgatatttctcaagtatcaaattagtggagttgaggctgcgacattctgcttcaccaataatctgcttaagatatcatctccctccatagagatagtcgcgccctttaaccttgaaaaatccatcactgttctcaaaaagaaaaaaagaaattccatcactgacacacatctatataagttgaaacattttgagcgcctaactgatgttatattt

SEQ ID NO: 11927 - DNA, 280 bp, Zea mays
cgccgcgaccaaacacgacagcgcttcacacctgtacctgcacgcgccggccaggccccaccgccaattaaacaagcctcccgtctcgtcccaactcccccacacaataggctggcagtggcaggcaaccagctcgggcgtgtccttcctcctccgtctccatcttggcccaaccgagcccaaacctctccccttttctccgtcctctcctagtccacacggcagacgccgccgccgggggagaggaggggaggggatcggctccaagggaacaggcgag

SEQ ID NO: 11928 - DNA, 578 bp, Zea mays
  unsure (1)..(578): unsure at all n locations
gntgtggacgccttcgttgtagtcttaataggagtagtatagattagtcatagatctaaaagtgcactgcataatacagtagttagctttttcttgctttaacctttatgttacatgatcgaaactcgcattaggccagtcgcccagacacagagaggaaacatcgtctggtcattgtaaggcctgaataaacatggggtcggggcatggcaattcccggtaaccaccagcgcaatttggacggtttgaaaggtgacaagtagtgggggtaagcttccgatgctgcgctcgtggtggttgtgaaggccggcgttgtctcttacctgcgaaggccggcgcaggatctatcggtagaatcggccagcagcgttttcgtggacttgtccttcgtctttaaggccaaaagtaatattcaaaaaacatttgaggtgcttgggtgaagaatgccacaatggaattggatcgacggtggtgcccccactcaaagcagctgcagcttatcaccaccgcctaaggctaaggatggaacgggttccgccggggctcaaattccccccaccttccaccaggccagcacc

SEQ ID NO: 11929 - DNA, 443 bp, Zea mays
  unsure (1)..(443): unsure at all n locations
gntgtggacgccttcgttgtagtcttaataggagtagtatagattagtcatagatctaaaagtgcactgcataatacagtagttagctttttcttgctttaacctttatgttacatgatcgaaactcgcattaggccagtcgcccagacacagagaggaaacatcgtctggtcattgtaaggcctgaataaacatggggtcggggcatggcaattcccggtaaccaccagcgcaatttggacggtttgaaaggtgacaagtagtgggggtaagcttccgatgctgcgctcgtggtggttgtgaaggccggcgttgtctcttacctgcgaaggccggcgcaggatctatcggtagaatcggccagcagcgttttcgtggacttgtccttcgtctttaaggccaaaagtaatattcaaaaaacatttgaggtgcttgggtgaaga

SEQ ID NO: 11930 - DNA, 578 bp, Zea mays; identical to SEQ ID NO: 11928
  unsure (1)..(578): unsure at all n locations

SEQ ID NO: 11931 - DNA, 444 bp, Zea mays
gtgaatgcggctgaaaacggagttcatatggtgggctgtcggccaccaccacctggaccattctttagacggttcttgatgcagaggacggcgcaaaaggcccctctactcggcgttttcgtcgaggtggataagcttcccgctgatcctcctggcaagatggaccaccatacaattacatacaggcatcagcacacctacgtgattccatttcgtacgaacacatctagctgctccagtaaccagcagaactccaaaccggaacaccgaacaccctagacagctctctgcacctgcacggacacgcagggtcgtaacagaaagaaagaaagagaaaacctctagctagcatcagtggtcatcagctggctataaaaatggagctgcttgacgcgaggaagacacacagtcagctcgctgatcttaattagctagtagtagttg

SEQ ID NO: 11932 - DNA, 225 bp, Zea mays
cgtggaatcttcccacatgggccgccggcacagggaaaacgccggtaacccagcgaggaatcaggctgccaaactaagccatagaggtaagaaaattcaaattttcccttctctcttttctatacaaatatacacagataaatacaatttcagcaactaggattttaaagatgcattgggtgtgagacggcctccggcggcggcgattcttggggttcggagtcc

SEQ ID NO: 11933 - DNA, 617 bp, Zea mays
tgtgctaacttaagcctagtttagatactcttagattaaagtggtttggagggataggagagtgtttatattcacaatatcaaagtctcccttaatacctttcgattcattctaatccacctcattcccagatcacataaactaggcttagggttaaggaaaacataaacttataacaaacgacaagcaatatgacttagaaaaaaatgggcagacattaatttaaaaaatcaaatgcaaagacagttaaaaacacggaacaaaagctgtaagaaacgcaaaaggtagtaatggagggagaaactagacaccactaaaaaggaaaaaaaggtgaaagagagaggaaagctctcgttcctagcttccttctcttcaactaagcgagcgaatccaacccatcccatccatttctcccttccctgttcacggattccaatccttcctccacaccccaccctcccttcgcctccacatccaccaccatccaatccgcgcgggtgcttcgccaccctatcccgattgctacctcctcgtggtgggcgccgctccgatccgcccgatccgcgctgctcctggggctccggcgcgcggcggcgagcggcggaggcggcgcagga

SEQ ID NO: 11934 - DNA, 330 bp, Zea mays
ttagagcatattgcattgcttatgcaccgctcccaggccaataaaaggtaaaaaaaaagtggatgtgatgatatagaaagctagttgatatcaactatttgggcttttacaagccataattctaacttctccggcccacaaggccacaatccaagccgaagaaccctaggcggtggcggcgcatcctgcataccccaccgtagtggcagcgagccagcgacctcgagtagcagcagaggctccgcaggggcgaaaaggtgtgaagcttccttcggagatcccagtagcagaagcaacgcaggcatcggcttgcgacaggagaggacggag

SEQ ID NO: 11935 - DNA, 477 bp, Zea mays
ctgcagcggtgctaatgatgttattttatctcatcagatcagatgggtaaataaagacagcagagttaaagtcgctggggaatgggtcccacatgacagtgggtaggctttgaccgcgccagagcagagcagctgaccgtttccgtttccccatcagtggagaactgaaaaatcacagttctatcaggggctgaggggaaaaggaatgacggagggagggagcccttgtgaaacgttccatctaccccctcgacgtgattcaaaatccgcgccatggtcccccatcccgtctctcccctagtcccctccgacctcttctaaaaatcctggtggctggctctcgttgtcctcaagcagtcaagctcctcctcctcctcccccccagtccctcccaggctcccaccccgccttgctcgcagcctccccaaaaccctagccctagccctagccctagctctcccacacccgcactgggag

SEQ ID NO: 11936 - DNA, 471 bp, Zea mays
ccaatggctctatctttgaaagctgcaagggtcgatgttggaagagaaaagtacgaccttgggagtcttagagcatctccaagagactagctaaatggcttaccaagccaaatattagctactcaatagtaaaataactctacaacagattagctatctgacttacaatactatctgattctctaaattagcttgctcactaattaggctagccaactaactatagataatctgttagagtggagatgttattataatttttataaaaaagataaatagggtcaaatagagagaaaaataaagagtctcttgaacatgttacgttggtaaattactcttggcccgttggccgatcgatcgagcagcagcgcccagcgcaaacatcatacgctcctcacgagtcacgaccgcacctcccgctcgatccattctctctccgtccgcccgcccgcccgcccgttcaacgcgcgg

SEQ ID NO: 11937 - DNA, 1500 bp, Zea mays
tactcgttatgcaagcttgcccctgctgaaatcccctgtcgcgcctcttgccaatagagtgcaagttacatgattcaaaatttcataatcgcatgccattttttcataatctgtttatttgtgtgaatgcatgagaagttaatcacgtctgaccgttcaatctttcagaaggttcaactccctggcatttttgttgtctttgttctcttctgcagagggacttggataacaggctggccaaggtagccaattccagcctatatataatttttctcaaagagacgatctcgtcatggagatacaagtcacttgatgtgatgttcttctgaaaagttaaatcggtttaggttacaggaaaagcttagccagatttaggataccacatgttgagattttgtagcctgaaaagtatctctgttaatgttagctattcaggcttcacttcggtaactagcgctgtgatccctcttgatgtacagcctattcggctgctcagtttctagacgttctgatcatccggttcatatgatatcttggatgctttctctgatgctatagttcttatgattgctcagcctatgatcatcactccgctaatgattgacagtttgcttctcgtgcagtggtgcatggtagaacaagtataataaaaggctataacctggctaaatgctgagttgaatgagagagaaatagtaggctataaacttaaagcgggcttagatacaaaaagttaaaaatattataaaagaaacaagtcgaccgtacattaataatgaagatctaaatattatatagatgaactaaaatataatgtacaaaaatttgtggtcgtgatctaaatattaacaatggtgggagtcaactttttgacatggaattgacgcccatgttgatttcaggagtcacatactcacattcaggattgacaaaaatatagaggtgaaattaaattttataaggagttgttttacataactaatggagaagagcttttgttaaaaattatttaaaaaatttatatttagaaaactatttacataactagtgcttgatttctagggactattttttacttcctctaagaggtccatgtccatttcaagcgaaaccccacgattacaggcagcagcgatgaaaaactggctaaaagttccaaaagaagaacttctgctctgcagaagagggcggcagcagctacggacccccgcattcctcggtgtccttcccctccgtgctcaacgaagcgcctcgtctccccgcgtccccggcccactcccgccgccctccgcaaccaacggaattaacaggcacgcccgggcgcacggcggggacgcgcggccgcgcgggagggcgggggcgacgcgcgcgcgtaccggccgttccgccggtagctcccgctctggcacgatcgtcgccgtgcgacaggctgctggccaaacgcgcgcgcgatagcccagggaaggacgaggagggggcaagccggctgaggaattcacc

SEQ ID NO: 11938 - DNA, 121 bp, Zea mays
aaacactgccctgttttatactgcttttgaggcattggtatcttcgtcgcaatttctggaattcttacattttatgtgaatctgcaggtttcgttcttgttaactattcaagaagtaggaa

SEQ ID NO: 11939 - DNA, 333 bp, Zea mays
ctggcccatatttccaaagacagggatagggttgagctgaaccagcccaggccgcatgtgtgtgagtgaacgggtttagcggtttagcctagccaggtttcctttactctccgcgaatctgagcctgatcggcctagtaggcccataaaagcacaatggcataccaatctagcccaacttggccgacgtcctgcacacacaaaagaaaagaaagacggccagtttcccgcggtttgcccgcgaaggtgccccaacttcccgccagacaccgctcccgctcttccccgctgagtagcgagagccgaggcccaacctagacggatagacgcggag

SEQ ID NO: 11940 - DNA, 1500 bp, Zea mays
tatcaaccaggtcatattaattctcttgtccaatttaatagttaaaataacctatttgaagtgtgtgaaagaggcattgcaattgagggtcttgagagttatgtattgcttgattagtggccttacagtgcataagatagtaatttctgtgcacacaatgatcttattgagctttaaagagtcaagtgagtttgttttcattactyttgatgatcgatgccacctaagcagttcggtggtgacaagagtgtggtgatcatccgaaaagcttatgggtgccccaactcgggattgtacacaatgtttcactgtgatggagcgacgaataaccatatcataaagagcacttggtctcaagggggcaacactcttgcgcgaatgcttcaacaagaattagtggggagtattgactttctgagacttcaacaaaatattgaagagttttctaacccttgctttactatacacatttatatttgagaaatttactttaagtatttaccttcttatatttgccatggcaatatagtattgaaaactaggatgtaaaactctctcctttttttatttatcacggtttagttctataataaactaccaagcgacaaatattcaagaatgaagggagtattaagcacttgattgaagttggtcttgcaattagagattaattcatgtattcccttcgttcataaatatatgacactgttgacttttaaaaaaactttgaccactcgtcttattcaaaaagataataagttatcgtttaccttttttgatttgttttatcacttaaggtagtttgtgcttgacttaaaattttatatttttgaataaatattttgaataaaacgagtgataaagtttttgaaaaaagtcaacagtgttatattttttgaacggaggtagtaaaaattattaaagaaggccaattcatctcttttttagtcatcatgatcatttcgactagaatccgtgcaagttaaactatcttaaatttaactaactatagaaaagtgtaacgataaaataaacatattatgtaaatactacctgatgttactaattcataaattttgacaacgcattcaaaaaaatatagtcaaaatttaacttaagataaagtaaatgcatgttatgtagtaatattgaacctgcaactatttaaatgcttaattttttcttgcatgagtttttgatcaaacaaaatccataaatgtgcatacatgattgcattctatatcagcattatacattggtttggatttttcatgcatcggtttaggcgaagtaaaccatggtttgacccccaaaaaacggacagaaatggcaaaggggcaaggggcatgaagcagaagcacagcttttgcctcacctctcatgagggtaaaatggtaatgttccggagaaagccagggtttcttcggaggctttatttatcgtttatccacggaacttccggtgccggcggcgaccacttgtggcgatccatccctcacc

SEQ ID NO: 11941 - DNA, 1500 bp, Zea mays
ggccaacaagttataggaacacctcctagccatccaagtgctccaaattgcatcgtgtgcataaaaatagacatccatttaagagctagaaagcaagagttgcttgagcacttgtagagagctgagtttatagccaagagaggagattgttataatcattatgattggagttgcaccccattaattgtaaagcaagcaagagcctccgacttcatgtggagagccttttaagacttcggtctcaccatttgagtaagagaaaactcaaatttgaacttggtgatcacttgactaacaaaagggttaaaagaaacttgattctttgtgaaaccgaactttagtaaacaaatcgtcatatgttatgcactttcactttccatttggatttgccttttcctcatctaagtttgtactccagagatgtcgattagctttctgttgttgggcctattgggcaactgttgtagcaccaatccgatgatgatttagcggcaaattatgctcaatggttccatgttagagttgtgtttttttaaccaaattagtactcccttcgtccaaggatgatatacctattttcagtgtgcactttaactaagacaagaagagtgtagtgtataggcaacaatggagagacttcatcgaaaggaaaatgaaactaagacagagtggatgtttcaacaaattctattcggtaaaggtgtttgatttctctgactaaaggtgtggttgatttctctgactaaagcttagtccatgtcctatcagatgtctttatgtttactatttgtatactttaaaaaatatgtgaatacaatgaaaggaataggattttcaaaggtggtaatatttagtatagaaaaaagctaattctatgacacatgtaagttaaagtgcctctagaacaagagtaggcgcccaagttaaagcacgaaacgtgtcctaaccctctgctaattaagcctagtacgtagctagaaaagaaatttaacgacgctggtcgctggctgcaccacgcacagcagcagcaaacatgggtcagcagttgagttgggcagcggtgcagtggtaacgtggtacaaaagatgtgacacgggagaggacaagaattgaatyccagtcccctactttcgcactggacaatgaattcactgctgccatctacacctactcatctctccctccttgcaactgcaactgcaacacatggcatgggggcgcaaggttccatggtcatggtgtggcgctgcaaatgcaatgcatgcatgctctactgttcatggctacgagcagttattgcgctggcaacttggcactgcccccgatctccctcaccgtcaccggcccatcacctaccagctgctgcttgccattaacattaacccctcctccctcctataaatccggtctccgcgctattcctccatcgaccatcgagctagatcatatcgatcgccatatatatagtagggagcggctcgcagggcaagaacgaagcag

SEQ ID NO: 11942 - DNA, 215 bp, Zea mays
gggtgtagagttgcatgaaacggcgtcacccgcctgacgtgtcttcagacgggtggaagtgcttattgaatgctttgcgactgttcagtgaccgtggttgaaggtgagcggttgccatctccctctataaataacgtcgttgcctctctggttttttcacatctcctcgctgctctttacttctcccttctcttctttccctgtctgcttctgca

SEQ ID NO: 11943 - DNA, 1500 bp, Zea mays
cgtccgggcgtttatcaaggtgagcagcgctttgtgcccatatacttttcatcctttcttcttgcgcgtgtgcttatccatgggtttatcggtctgagctgttgataattttgtgttgtgggatctggtgtgctgttttctgtaatccgtagtgaccagttagatatagttttcatggtttcgtgcgagccttgagttgtttgatcgatgtacgacccattagctgtcctcgccgtattcggtttatagcacccttgtcgatgctcgctggcatcacgctagggaggaaaactaccggaccctcttgccaaccacacctgagacttgatgccctctcctccaagcagcaatattgtgactgacaagtgtttcttagtgacaacatcatctcttagtccttcaagcgttggtctcctgctctaatgctaatgttgagtaccgggctatcgctaatgaggtgctgaggcgagttggctacgctagctcctctaggagcttcactgtaccctctccatgagtacacttgtctactgcgacaacgccggcattgtctgcctctccatcaaccatgtccaacacgagcgcacgaagcatgttgagatcgatcttcactctattcgtgagtgtgtggctcttgtggtctcgtggacattcgtgttcatcatgtcatgacaagcttgcagtttgtcgacatcttcattaaaggtcttctcttgttgttctcggacttttgtccagtataaacatctatcgtggctagaggttttactacgggggtgttaaactacttgtatgtgtgtgttatgaacctagagctcaggccattaggggtagaatatatgtagtacatgtaatactgcagcctatctatctataagggtttctttctctaacactatcatgtaattcttgtttgatctctcccacttaatgcatttaagatcatatgcaattgtcaaggtgcattattagtggcgtccaacttggtcccatgaccgaaaccgatgagatcaacccaacagtatcttgccttccttaacttagctttaagcgaaaattcattcttgcctgcaggtgatgcaatatgatttgtgtttgcctttgattttgctgattccagtttcatttgcttttacttttctgatagtatcattacctggcatcatagcaaggtgctgtttaatataaattggttcatcacttcattgccgtcgagtattctaaagcaataatttctcagtgagacaattgcatgtccaatttaatatgaaaatcggtttctctttatgtttggttggattttgccttgtcaacttaatttgtaccttctcgtggagatgcatattgattccttttgtattcatttctaaataaatgcttgcaaactttgtttgttggttatcatcttagaatttcgtgttccttattattatgctgtttagtgttcacgtgcgttgtcttgttttacaggaataggtattcaagttttgtatcaccaag

SEQ ID NO: 11944 - DNA, 662 bp, Zea mays
gcatgcctgcagttgacaagagcacacaaacgccagacatgacttttcactctatacagagaaagatgtaccaaccatgtacacacaacagatgctggaacaacatgagaagccaaccatgtacacacacaataaatattgaaaaaaacccagccgctctctcacaaaacaaatagaatgaaaacataacggcaaggataagtatacgagtaaaaccagtcagacccatgtatgcatggccactaggggtgcacaccattccaccatcacatcatcatcgctttgagttgacctataccaacacaagcccatgaggtatgtacatatacacccatgcatgaggccatgacacacatatattatacacctaataatcggtctatcaaaaaaatcatgttgtacatatataaaaaggcatttattgttaattaatacagtagaacacaattacacaacaagaaagaacatagtatgcccatgtacacttcagtatatagggagtgatgagaagtgttatggcacacctgaccttccccacacacacctttcacttgacctcccccaccccggcccatttccgctccttgaactgaatcttccccagaggccagactgccagagcatatatctctctttgggtcgttgggtgtagtagtgatcgg

SEQ ID NO: 11945 - DNA, 673 bp, Zea mays
tgcatgcgcccaagcgcaaggatccggtccgccattgacgcccaaggattgagggtgtggatgtggaccttcactactgcgaagtccgtccgcaactacacttaatttacaagaatgattagttgctccgacttgcccacctctctctttgttttgtgctgacctctgtacccgtttttttattcatgtcttttttatataatttacaagaatgattaatttacaagaatgattagttgctccaacttggcccacctctctctttgttttgtgcgacctgcagcagtctcggcgaccgaagaaaccaccagccacgccgctgtcttgtctcggctcctccggtggataggcaacccccacccccacccccacccagtagcgtgcagctcctctggtcactcgagactggaccaaaataccaagttgagtgaaacacgtgcacctgctctggtcaggtttctgcgaaactggccaagcaacttgttgcagttgcagctcatctttccgtcagtttttggcttttggctactatatcatataataccggctaccgatgccattgtcacgcatgcatagctgatgatggtcggactctgagctcctctccgtgccaagtttctctgcacccatcgcttcagctcaccggttctcccccctgcactgcgctggctgt

SEQ ID NO: 11946 - DNA, 1226 bp, Zea mays
ggtgagctcgcgcgcgcgcgcgttcctccgattcgccgcgcccgtgcctcggattcgcacgattcggtggcgttcgtgccgcaaacttgtggtcctgcaggcactagactggggcagggtttgtgtgattttttttttgtgttcgtcgctgagacgaggaactttttttttggtggatttggcactggttttgggggtggcttggcttcttgattcgatcgattccctggggattttaggggaatttgtactctgctggttttcggaattgtttgccttgaagttgaaggcaaagcttctctgctttttaccccaggcagaaaagtttggtcgggattattctctgctggtttggtgcttcgatccagtagcggaggattagtttcgtgctacaaaaaggatgttggacgaatcaggtacaggagggcgctctgttttttctccccttggattgagctaccttctaattggatgacactgtactgtcttgagtacgtatataagactgaaaaaagtagtggcaggtgaccacgttgccagcccacctcacgcggggtatttttgggctttcgtttgggccagccagaactttgggtagctttcagctacaacctcgaaaggaataaaaccaataggaaagtcattggagcataggtagcaccgatagtctggcacaaggttcattggcgtcctagtggaactctcctctctctctctcttcttttataacaaaacatttttaccatttcaactcgtaggttccttgttgctatgtagttcatggctactgttctacattcactaaattaggttatagtaataccttgctggacagttagcaccttatccttgatggatatagctctgtacaaagttgtggattagtaccatggcttcctgtttgttttagcaaagttaggcagagtataaattccaatttgcccacttcttttccttctttggtctccttgtttcactattcttgggtcatttgcagttcttatcgaactttcctggtcctggattcttttaattagatagcatggaagaaaggatcttgacaaaaagacctagaatcttaaggttttgacgttttgtttgcagagaaagagaatctgtgtttgtatggtcttcccaatgaaacatgggaagtgaacttgcctgcagaggaggttcctcctgaacttccagagccagctctgggaattaattttgctcgtgacggg

SEQ ID NO: 11947 - DNA, 372 bp, Zea mays
tctgtaatacagaaaacggaattctacagctggacaaaaaaaaaaaaaacgaagcaaaccatcagctcctccagtaattcaggtcaaacttgcaggactttttccctgaacaatcagccttacagaataatagaccctatgcgttgaaaatccacgagaaaagacaattttcagcaagcgaaaggatgaaatcaatgacaactaacagctataaaccagattttctgtagctactagttagattggcgcgacatcacagcaatcgtgcccagaatcccgcttagaatctagatctccgcagggaacaagacaagatgcgcatgtaagggttaaggacgaggtggaccgtacgggcagtatgacttggagaag

SEQ ID NO: 11948 - DNA, 808 bp, Zea mays
ggggccttatactttaatagttttgcccattgttttcaaacagtttcattaaagcggacacattctgtttatcatgtatgattttattgggttgtggggttgttgttgcacacatttatatttatttgaactgaggtgccattacatttgagaataaataagggtcgttttgtctttaatcatgttgtgttattaggctgaatttacccacacgacatatcaaacaatttgcttaactatgcattgattaattaggtgttatttcactcatagatgagggctgactagtcatatatgacatgttacaacaaatgaggattttgtggagatcattctttgcacaaatatgcactgtgacctcagcttctgttttaacaaacagtggaccaaactattggcatgagactcttaatttgtagtcatagtgcaaagtgtatattgcatagttcgtcattattatttagttacttggcacttgtcttcactatccatgtaaggtcttgttcggttaatcccgttacccatggattgaatgagattggaaaaaattaagaataagtttgacttgtttgggatttaaacccacccaatcccaatcaatccatatggattgagagctaaccgaacaagcccacacatgtctagttggttcaactgtaccattacgagcaggtgatggaccattgggtttatgacaaaaggtgacaaatatcaaatacacgcccccgcgctcgaaggtcagatcatttttgttgatcttatctagcgaagtgatggcttctttttccaggatcatgagcttgttgag

SEQ ID NO: 11949 - DNA, 738 bp, Zea mays
ccgggaatttaattcggcccagtagtcaaataatctgccatagtataaacttcgtgaagcctgagttcggcagagattccgtgaataaaaacgattacaaaatcgatcaggtttcctggcgttcggcagagattcgtcaagaaaaacgacgacaccttttgcgtggacagaagtcagggttaggaaggaactcatcataattgagagatatcgatctcagcgcgtagctagcgtagttgtcgtggtcgttgatcgctagtcagagacgagacgatcagctggatagcgaccggtttccagcgtcctcgcatgcggtaggagtatcgggtaatatgtcccatctacgtgcatggtgcatctatatatatccggtaataatccatgcatggaagttttaacgatatgtttatttcggtagctgatcaatttctcgatcggcagatacggacggacacgggcagcaattcagtcccgcgtcccccggacgcgctcttcccatcgttgaagcccagagagaagggtggcatggctataaacaggcagcgctgtcctcgcgcctctccctgcccggcccgcgtcgtcgtcgtccctcccgaaacaaaagaagctattttgacaccacacacacacacacagaggagagaagataagagaacgaggggcagggcagccagcgccgctagctgaagcagggcagggcaagagaatccgtacgtcgaggtgcaggtcgtaggtagg

SEQ ID NO: 11950 - DNA, 190 bp, Zea mays
gtagagtggctttcctggctgctctatgctctatagacaatctttgtgttgatgtatcttgttctcacatgttcaggctagtagagttttagggttacaggttcttccccttcattgctcttctctttttctctctttggcctgcttcagttttgtagcggtgttgtgtaattctattcttcttaatgaa

SEQ ID NO: 11951 - DNA, 400 bp, Zea mays
tcctggaacacacacacacacacactctctctctcctctcactgtctgcacacgccggccagaggtgcactgcctccagtcccgctgtgcctgccgtgccggatgggcagcgctcgctgatgtggatgcggcaagggtacacctgcagcacgccgcccgggcacaggagcgcgaacagcgccgtggcgaagatcgacggcgcccagtccctcatcgcgtcggctgtgcagagccgtattccgtatattccgttctgttgcaaactttgacgaaaggtggtccgcttcgccgatgatgtccgaacgcccgtgatgtccgactgcccctacctataaaaccagggcaccacgcccacgttccaagatcaaaacgtctcgacaaggcacagccacctgaagca

SEQ ID NO: 11952 - DNA, 187 bp, Zea mays
ttgcttcaggtggctgtgccttgtcgagacgttttgatcttggaacgtgggcgtggtgccctggttttataggtaggggcagtcggacatcacgggcgttcggacatcatcggcgaagcggaccacctttcgtcaaagtttgcaacagaacggaatatacggaatacggctctgcacagccgacgcg

SEQ ID NO: 11953 - DNA, 91 bp, Zea mays
ggttagccgttagctctgttcaaatcagaagaaatcctccacttgctgccctttgctcgagtcacttaaacctccattgctttgagtacag

SEQ ID NO: 11954 - DNA, 236 bp, Zea mays
aaaaatggcagcacctccggcccgtccaaagagcacctcgtcctcgtagctcaacatctagcagattgccatatgcatcatctgctctgctagctatatatatagacatggagtggaatcaagaagccattggcaatgcaagctccagtcatcagctagcgatcgagcgtcccggccccatcgtctgctgataataaagcacaagcagcttccaagggatcggactatcggaggca

SEQ ID NO: 11955 - DNA, 208 bp, Zea mays
ggtggtctactacgagaccgacacttcatcaacatcgacctccgactccgatgcgccgtccgtaacttctaagcgccaagagcgcaagaagtttagtaagatccccttacactatcctcgtacatctagacatactccattactttccgttccattaggcaaaccgccaacttttgatggcgaagattacgctaggtggagtgattta

SEQ ID NO: 11956 - DNA, 307 bp, Zea mays
gcgagcaaaaggtaaaaaaaacaagaataatccttttaggatcaaaagtatttttttgaaaagattaaattgcagaaaaaaacggtccggtaccccttgcctgtctctcccagtcgtttcccgggggcgctagattcagatccatgccgcacgcttctccattcctgtaagctcctgcgcctcctcctcgttgcttcactccaaatccaccgaggccaccgcccgggcccgggggaacccctagcgccgccgccggctcgggcgccctctcgcgcgcgcgtgcgtcgctccgacagcagctgcagcc

SEQ ID NO: 11957 - DNA, 1500 bp, Zea mays
ttgtttgaaaccatctagtttttaaaaaactgatttatgaaaactgagatagttccaaacatactagtttatacatcagtttataaaaattgtattcacagtttcttaaaaaccaaaaaactagccccttatagctaaaaaatgaaactagtttcttaaaaactggtttgcttccaaacaaaacctaagacttagtcccctgactaaagtttagtttcataattttgtctcgtctttttgtcttaatctatataattaattttataattagactacatttaatatttataattattattcatttcgatatagtagggactaaacttttagttgggtttaactaaacagactgtaaacatattgcagcatcccaattgtagatggtgatgttttgctcaggtgtccacgtcagtcagtatcggtcccccgatcagctttggagttggcccagcctcacaacgaataatccttttttaaaaaaaaatattctctggccgggtatatgttttgccgagatttgcaagtgacccagaacgatacattaatcctatcaatcagctgcagatttttctcccacaatcagctgcgtatctgaattcattaatcccctgatttgtctactgcccctttgactctgccaaacctgggcacacgaaaacgagaacttgagcagttgagcatggacatggagcaaagtagttgttgacttgttgtgtcacctgacctaacctgtataatcccttaacccaccagaaaaacacaaggcgacctgcactagaccattagaagaaccttttttgcccatggccggagtccctgactccctgctgcggctggggcaagcggctagggttctgccggttcttcaaacgcgcgtgacattgacctgtaccatctcccgcttctttatcctactcccaccctctccgatgatttacatgccgcgcctttgcggggcaggaaagcagacggatcaacacgcttcctcagcgccatacgcacacacaggggacagaggtcctctcgctgccatttctctaatcgcatgcacatcacgttctcgcgtggaggatatgtcttgccttgcattcgccattgcggattgcaggcagagggaggcagctgaggattaattcaggctgcctctggctgctcgtctgctcgctcgcctgtccgcttcaaaattgacgcccgtgacctttggtaaaagcgagagctttcttcttagcattatccgctgggaaataaagagagtgcgggagacagttggaggccgttcggttgctggatcgtttgacaagggtaactgatgtctctttttttttttgatttggtgatcgtcatctgactcttttttttctgttatgcaagtaatagaaatggagtgatctccgttcgaaaaaaaaaatctgactctgatcagttcttgaaggttgctgattctgcaaggtgcgactcgaattttcttgcgcagcctagctagctaggcgagggcggcca

SEQ ID NO: 11958 - DNA, 47 bp, Zea mays
agaagcttgagaattggcatcatctcaagaatacattgaagtgcaag

SEQ ID NO: 11959 - DNA, 1500 bp, Zea mays
ctgggcgatgttgaactcgcggtagcgctgcggacgcgacgagggagaacgtccgcgagaaggcaggcgacggctggggaatttctagggagccgacgagctgttgcagagagagcagcaggtccagtaggcaacagcgaagttggggagccgagcgccggcacgacgatacaggagctagagayagtggcgttcagcagctccacacaatgatgtgccagagaaggagacgagaacgcgtgcagtttcagccatgatccacggactcccaacacgcaaactccaggaaggaagagatcgtgactggcaagtggtaacaacagaacgacgtgtccaggtgaggcaagtactggggagaccgagcagagaggagagcgggctgagaacaggaatgcgaggggcactacgagaagggagctcggctgctgctgcctaagcgatggggtgaggggatatatgacgtggagaagctagtgctcactgctcagggctgcacgtggatttctggagatgagacaacgcacggagagacttccagggagtacgtgtactagatattggataagaacgagtggaacaaaggagaaaaatttagagaactgagcacgtgtacaggataaacatcagtggcatggagatctttttctcaccaaaattgaaccggtttcagtcagctgaacaatattcagtccaccaccagcccaacagctcgacttggagcaaagttttcttctaatctaaaataagaacagggagatccttcatcataagaagtattcctccataatagatctccaagtttgatgtaatggtcattcaccaagaattaagagttagaagggtccaacactgaaaggaatacatggtttctaaaaattcagcaaaactgaatacgtttcagaatctgaactgaatttggcaccaaactgaaccctcatttgtaaccccttcgatcctcatgattccaagcaatacatgtcaaccttggttaataaagtttgttcacaaaatgtaactttacaagtttacttcaggaaccttaggtcaaagattcatagatcaaaagttataacgctccagagtgaggtgaatacactaggaaccaggtaagaggggtagttatgaaccctgtggaccacccccatgggggtggtgaagggaaagcccccattggtagaaaaaaacccacaacccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacatagg

SEQ ID NO: 11960 - DNA, 89 bp, Zea mays
atgaaaaaaaggagtaatcagctgtgacacgaaaaaaaacgaatccttttgtagctcgtcatttattggcaaaaatcgaaaaggtcaat

SEQ ID NO: 11961 - DNA, 96 bp, Zea mays
ttaattgaattcagaatagaaagattcagaataaacaaaatttataggattcaaataatcaaataaagtaaaggtaggcgggtaataaccttattt

SEQ ID NO: 11962 - DNA, 65 bp, Zea mays
ataatctttagatcaatctaagatttcgattcccagtaaaaaaaaaagaaatataatagaaaaat

SEQ ID NO: 11963 - DNA, 147 bp, Zea mays
tgttaatgacgcagaccaaatatttttttttaaatagaaatttagggtacgatgagtgccgattgcctaaaccccgaaattataaagaaaaccgcctcggccgcaacttgactatctttgtgaggaccttcaaccatctcaggcgga

SEQ ID NO: 11964 - DNA, 1500 bp, Zea mays
ttggtatggtcggggcatggtttgcacatgttcccttcttactcaagcgtctagggattttagggttgtgatctgggtacccctaattatggtacccgacatgactgtaatatgaaaagaaacttacattatccagaatgttttgaaaatgtatatattttattatgcaaaccaaaagcattactaaaccacataggtgagctttcacacgattccgaccgaggtggtggggatttgtcgatggtatgataagccaaatctatagttgttcatgatcaggaaaatcaacctctttaatatacttgtacaaagtcttctagacttaccgctcatatctaaataatcttctagtgcatgcagtcctaaaagacaggcatagcatctttacttaggatcggtcaagtgtccatcgcttgggattggttgcacacaactaaagctagacgagcgagttcaacgccttggggcggctgcaacactacgagcttggtggccaaagaaacggtgtagtaccattggtgragcaagaacccgaagaagcgcatttcatatgaatgagggcgtgattcagtgtcaatcactacacatcacttgcacaagacaaaaactagtgagccgatgattgccaagaagtctagagagtataacataacaatagtagaagtagaatagaacaattaaaatatatacaacaatacatattgctcacttgtgcatgtgacacagattttctaaatggcataaatatatatgcttaatggctatttattttttaagagaagattatgttgacttgagatgaacttattatagaattcaaaataataacttagaaaaatgattaaaacggagtaaactgtgtgtaaaaatatttttgcaaatggacaccttacataaaccgtgcgtaaaaagtatttttgcaagctgctcaaagctttagcttgcaaaaattaagtggcccacgagagggtggttggacaaagtttccgggccttaaactataccaatattcaaacttcaatctgcaaacagtgcaatctacagtgtagatcaatgcaaaaaaatagtgtttttaggtaaactatggatagactgttgtagatggttttatcctcgggatcagacaagaaggagctcaagacggagatatccgggtcagggtcggggttcgggcgacgaaaccctcttgacaaaggtcgggtgagaggtgcttaagaaggctgtttgcaagtataaatttaacatgttgtcgctttaagttagctatatggaaaatagggtgcatttttagagacgaataacattttctgcaaacggtttgcttttgttccaggaagccacattggcgatgtatatacatcataagaacaccaccaccagcaggatagtacccaaaactatttggcaaccctcgctcgtcttcgtctataaatagacgcgtctgctccacctggtctactcagtgcttaagcagctttagcttgccagcaagaagaaaat

SEQ ID NO: 11965 - DNA, 305 bp, Zea mays
ggtagtcaattgaaactatttgatctgctttgtgccaatcttctttcagatttgtcaatgctggtttttgttgctgattgtaatatcctatatatatttcttttatggtgagataaatgaggggtgtctggtgcttacataccatgaaacatattatgctgttaaatgctacttctgtcaaatacgatgtggtgcccacttcaatttccttgcaagaaacttgctttactaatgtagttttctcttgtgaaaacattatgctctgcaaggtgagggatgagctagagcatttactggatgatgaa

SEQ ID NO: 11966 - DNA, 1500 bp, Zea mays
tttaagcactagatatacctgagaaactcgttcatataatccagtatattcaaatattgtattttattcactaaaccctcaagacatatctatgggtggaagtgtatcttagactagagaatgatgccagagacgttcytccatcaaaatatgtttcttgtgtctttttgcacgtatgtctttaaatactccttaaaatatgaataatttatgtcggttataaatgccctaataattctgataaatctaaagttgctatgttataaaagggtgcttggttctaccaaattaaactttagtctttgtcacattgaatatttaaacgacaattatgagtattaagtatatagtctaattataaaaattaattacatagatgaatactaatttgtgagaaaagtttattatgtctatattaaatattcataattgatatctaaatattcgatgtgacacacataaaacggaaatcaaacaccctctaaaaaatagaatgtcaaggattcatatttcatacagtaaaaacctaggattcctatttcccattaaaaaccttagacatgtagttttagaatagatctcaaagtttgggccagaccacttaaagttgcatagacacgacctgaaaataaaagcccgaagcaggatccgacacgaaaacggattgaaccggcgcgacctgaataaccatgtcgtattgtgcctcaaacttagacacgacgagggacatagcacgacacgattaratgagccgtgcttagatcagcacgacacraagtgaaaactaatgtttaaatggttatttactgctccaacaatgttgatctcatcataaaagttatataaaacattgatacttatatttatcgtaatagttttgagtcacgtgtctagttatatcaatttatttttaaaggttctttttctcgtatgattttttaatgtataacaaaattagaaatatttaaagatgtatttttagatacatataagttttttactcgtgtcttgcttgtagcgacacggcatgagcattacctgtcatgctttaaagccgagttgaatctagcttttaatatttggacacgatatggtttaacccaaaattattcagtgtcgtgttaactaaaaaaagttaacctgaagcatcgggccgtaccggtgtggcacggtcggcagccaagaaaaaaaagacttttttttttgtacaggcatcaatgcatccatgcagattcccaagtggagttgcggcggctggttatcatttatcatcaccttcgcctcacaccttccggccgcccattccgatccgatccccggccggccacctaccaccggtcagccccatcaatctctgaggcagcgtcagccatcacgcctccctcatcgatctccccgccgccgccgctgctaataccgtgcgtcggtgactcaatcctcttctccaatcctatactgctacccacttacacctgatgttttgatttcttctcagagata

SEQ ID NO: 11967 - DNA, 812 bp, Zea mays
tgcagccgcagggccgattgcatatccggggtgatcattaacaccggaccgctgtggcgttcggtgatgctggcacactcaaccgcctgcgcggcgccgaccagctgaccgagctgacgatggtcgcctgctttagcaggcagggtataacgacgctgttccgacataaggtccgacattctctcctcagtttccagggcgtcatcattccacattccgccgtgaggatcatctctcctttctgagtttatgtcagggtgcatgaatgcgcaccttacctcagcggcaccctgaaggggcgccagtatggccagttgccaggtcgtcattgatggcgacctggccgcgtcacgttatttactggattgctgtgtgtagtgcatgcgtggacgatccacattggcccatgacagctcgcgctcgacatggtagctgttgttgccatcgtcccacttcacataataaccggttagcgcgtctccctgctcaaagacattgaccacttcgcctttgatctcgccagatttatgtttaacgatactgcctttaggaaacctgctcatggtaagaacctcccgtactgcgcttactgtgatgcgaaaaccggtactgcaagctaagtctaacccacctgctgatgaataatcgtactaatagcgtaactattttgtcgtaattttgtgcattgtcgcgcaggaggacgcattttgacgcaactttgcaactgactcagcgggttagaggtttcataaagcagacggctcctttatcatcgctctacttaattttgggcaacggccaagacggatctc

SEQ ID NO: 11968 - DNA, 1153 bp, Zea mays
gtcctaattaaactagtgaggtagataataccttcgtatttggaaagacttttagaccgaaaggataataaaaaacctacaaaaccataatatcttgtttggatgtagatattagtgtacggaatttggaattagaatccactttccagaattctattgtttggttacatatgaaattgagatttggaatcgaagatctaattctctggaattggactataattaaaactctctctcccaatgcagagagcatcactccattgcgtggaattgaaccacacaattccaaattacaattcagtgatattcaaataatagaattaaaattacatctcattttaatatcatgactgatttaatattgaatccaattcaattctatatcttctaatattgacatccaaaagtaggagtgtataactgtatatatttgattaaacagatccagtaagtgagtggcaagagatacttggataataaagggaggaaaacaaattaaattataataaaacaactagaaagggaagtttccgaccacgtcgtcttcctcctgtctccccctctcctccgccactaaccaaggaggcgaagacgataaccaccgacgtgccttcctccccacatgccctagcgatccgttctcatttgcagacccaatccaagcccagagcaatcaccaagcctggcagattagatttccaccctcacatggaggaaaaatccaaccttcgcatgtgacctctatttaaatccccgcaagaatcgatcaatcaatccaaaagggtgcaggaaaacagagcaatcccgttgcttagcgtgttcgccttgccgttggcgtctcttctccgttcctcggcacgcgtaggcctatttaaacctccgctaaagctcctttgtcgcgcccaattcggcagccatttcccagattccccattggcgagggttccccgcgctgagatccaatcttttcagttgttcggtttcaatcggtgtaaattcctccagaaagaaacctagaatcgcccccccatagttggaaaaggtttccatttctgaccggttgtcgagcctggctacgttttgccgagcaaaggcagggcgtccgttcggttacggttcttgatccggcgagggaccgccgctgccgaaggca

SEQ ID NO: 11969 - DNA, 187 bp, Zea mays
gcccgataacaccacataggcaagttgtgaattacagatggaaaccatgtgtagatttttctggttgtttgttgacagctcttctgcttgtcctgatgttccattgctttgtattcttcgcttgcggcctgtttgaaggattaggggggattgtttatgctatgattgtatttagactgcatgatcc

SEQ ID NO: 11970 - DNA, 316 bp, Zea mays
gcgtccttgtctataggttgcacatgtcctaataacaagaatcgaaggacataataagaaaagtcaaccatacatccgctctcccgtgccgccgctcaaaggtcaacgccctctgcgcgccgtccacggcctcctccttccccggtcgtcctcccgccacccgctttcgtcgcgcgggcaatttccgtcaccccgccacgcgcccaaacaccagcaccacacgtccatttgcccagcaggaccaccccgaccaatctatcgcgagcagcggggcgatcgacctcctcgaggacgacggaaacgtgcgtaccatacc

SEQ ID NO: 11971 - DNA, 126 bp, Zea mays
tctttgcttgcctgcagattttgtgctcgaggatcgagccccttctcactctgttctttttccttccttccttccttcctttctttctttctttctttctttctttcttgtgctctgctttgcttg

SEQ ID NO: 11972 - DNA, 915 bp, Zea mays
tgcagggtaattctaatttactgaactcactagctaatagaaaaaattgcaagaaaattcataatatctggcttattagttttgcactgtagattgcagcactatttatattgtggagtttgaaataaaagatgacgatgagtaagaggctggagatagaattttatccgtacaaaattgctcaaaggagggcctgctaggctgctatactggctggcaactataacctaaagatgagaaattgccgcggttcaaaggggcgttaagggaatgtgcactgacagtgacaatatatagattcgatacatcccaatcctcacagcttgctcacatctagcaaagcaaaaccagtaaaaaaaagacaacgggactgagcccggcgctgaattaaccaactgatttcaggaggatagggggcacgaccgccagagaagcaatcgggagaaggatactgaagaggtagcgctcccaccaatcgagcatgtagaggccgatggtgacattgtagaggtggatcttgcgcccgatccagttcatcctcgtccctcccgcgaccccccggcgccgcagctcgcctcgcctagatccgagagaggagcggcgcgctgtttgattcttctatgacttcgactctacgaggattgagacgacgacggcggactttgagcgctgcagatcaaaacccatgggtcccgttgatgcaggatttgtcgggtctgttgttaccggttgagatcgaggtcctggaggcaggtttgattgtcttgacgggcttttgggacatgcgtgcagctccaattgtttgtttgcttggactgaactgcataggaggctgttgctatccaaaattcagagcaccctgaagccaacgagataattgtcattatagacgaagagagaaggggattcgatgaa

SEQ ID NO: 11973 - DNA, 402 bp, Zea mays
tccgcgctatcgcagagagcaccagcgtcggaatacctcacagtgattagtgattgacgtccatatcagcaccaaccgttgttgtttcatggaccgaggaaggacgtgtttagttttttccacgagcatgtatgtgttgactgacatgcccgagacaatgtacaataaaatatgattattggaggtttgtagcatcaggccatgcatcatgaagacgaaggccctgcctcgattgatcggtgtctagctatctatataaaggccatcatcagcttgccattgcaatgtccagtaattacaacctgatatgatcaccccggccggctggcccacagagttcagcaactgaagggtctgtgcatattcatccatatggcgaactcagcaacaccgccgcctacc

SEQ ID NO: 11974 - DNA, 1409 bp, Zea mays
ctgaacccaatgcacagcacaggggtaaatgctgctctgatcaactcaagatgttcatactgggaaataaaaagtgacctctgctctcccagaaatggcgattatatttttcacagccagggaaagggagatactacgtactggggagttcactcgtgttggctacagacagagtgatggcattttatttaccgtgcggtcttctctgtagcactggtgctgtgtacgacggccgtgtgtcacttcttcctgaattctcatgcgtgtgtcatttgcaccaccacctactactagttacatgtactagcagtagtacttgtgtgattgacctgccctgttctgtatacgacagagctaatgcagtattgccatgctttgtagccttactaaccattcttaattccatggcatatcgtgttaaagcacacatgctgttcccaattgccatgtatcttgtatcacgcctaaaaaaaaggcatgggatgcatcaggacaagcaacgcaaaataaactgccaattggcacatgaactgatctccccactccacccagtacgctcacaattggaagaaaaaaaacttgtggaaaaggagaaactatatataaatgcaagtagtaaggtggtagagaatagattacagtgtaattcagtatcaacgattcccgaagcagtgcgctgtgcctcgccgtcgccggccggccggtcaggaaagctgcgagctgctttctgaacactttgttattccgtattcatgacacaaaggggattgggagagtttttttttgttgaagaaattggagggcgggacgggggtgagaaaatatgaataaaagcagggaagggggaaaattggtcaccgtccctctgcgaatctgacggcgaaaagacacaaagggcggcgagcagccctcgtcagcaagtgattgccaatcgcaagtggcgcgctccccatttcatcagtctccggctctccgcaccaacttggagaaggaatccctgttggctgttggttttggcccctgtatattttctatcgaggtcgaggcctgatgctgatgcctagtctattctaggtgaaaacatggctgtctacgtgttgcatcccatgcctgctgtatacgtattcttcttggtgatgaaaaacatggtctattcttgtcaaaacgaacgtcccaaaccgaaaccgtccatccatgggccggcagcctgcctgttatcctggcccaggttacgtgctgcatcctgtgcaccttggcccaccaccaccctcagtcgaaggccccctgccacactgcggccccgcctcctcgccgtctctacaacaatgacgacaccggcggcggaggccgtgtcgcgccgcctgggagcggccgtgcgtggcctctccggcgcgtggtacgggcgccac

SEQ ID NO: 11975 - DNA, 881 bp, Zea mays
tgcacgcacacgtacgacacgagggcttgacacgttgcgtgcgttggttagctaaccgaatcccagccagcggttttgccgccataaacgtgtgaaacaggaggcgtacgtctgctgcttggcggcgcgacaacaacgacgacgaggacgacgacaagggcgaagtttggaattgcttcgctcggacgaccgtcgccctcgctttccatttccagtttccgacctccgtgtccgtgtccgtgtctatataaacggcatcgccccgcggcttctcacccccctcctcctcctttctccctctcctcgcctcctcttcaacttgaagcagcatcgtcaaccctcaacagcccttaatctggctggctggtagcttaatctagctagctaggcggtgaacctgataatgttcttggactccggcagcttcttcttcaagttcaacaccgcccccgcgcaagcgcttctcctcctccacagtaggaagagcttctatttctggatcttccacgtcttcaacagacaccccctcctcctgctccattgccattaatccaaacaatcgccgctagctagctagctctagtactgtcgtctacgcacaccagctgctcctaatcacctgcctgaaatatttacctggcagttgacattatattccaggtccgttattagtgttggcctgttgggtcgtcgtcggcggcagcattattatgtttgctgctgctgcggccgccgccgcttcttcttcctcctcttcctgtccgtgatcgcgtcccacatataagtactcatctttcagctctttcttaccatccatatcctggctagctgttgctgcctgaaccaaaacacacacacacacaaaacacgcaatgggcgcc

SEQ ID NO: 11976 - DNA, 216 bp, Zea mays
tgtatactggcatgctgcagcacctgcagccctgaccggcgacgattgggcggccgtcgctgcctccttactccaggtgtccagctcttcttcgtgccatttgccggccgtgagcaccaccaggtacgccgaccccatggtctccccttgctgctgtacaaaaccgagcacgcaaagcctaacttactatttgcattcggatctggtttagacggg

SEQ ID NO: 11977 - DNA, 182 bp, Zea mays
ggtacccggtacttttttctctagatttggcgtcgcgagactcctcgcgcttctcgccgagagaaaactagggttttgctcctggaatctcctcccccgcagccgccgcccgaccgtgcgccaacgatacatccttctccctcctccgatccggcctttttgatccccggatcccgtacaat

SEQ ID NO: 11978 - DNA, 969 bp, Zea mays
atgtggacttgcatgccgtatgtatgagctcaggctgaaattacgtgccataggaatgctatttctttcatcctacctaagggcctgtttctttcatctacctgtctaaggctgtttctttcatattcatgcctaaagctgtttcagccttgtgtatgaaacagacggagccttgtggatgaaacagacaggccctgaattcccagagttttctgaagtctcatcactcaggagcatgtgacatcgttatagaatatgtgttagtccttcaccttgaaattactaagttttctaggacaaacctttggccaaaaggaaaccatttttttattcatactatgaggttcgtatagaaaaaatgtttgcttacgattatcatttatcatacaaattacatcaatagaataattgctggtcaaaagacttgtcttcaacgaatgaaataaggctttgtaaatttgttaagctttgttttgttgctgtaaatcttgtggttgtatgcctgtatttcagatttgtgacttgaacgatttgtgggccggtcgttaaaccgctacaggtgtctgggcctgatgggccagctccctccccatagcgcttctattctcccccgcccaccgcggcaccgccgccgactccgatctcggtcgacctacccagtccgccaccgtctaccgccgcccccacgacgatccagtctctgtcgctgccccgcctcccctcctcttcccgctgcctctctcggtctccctgccccgcgcgcaaccggatccaggtgactccggcctggacacgtcaccagacttcctctccgccgtctgatcgggttagcaaaaggaaaaccggcctgcttcgcgaggataagaaaaggtagcaatagcacgggtaagtaaaaacgagctgtagctgtctgccggtcggtctgtccggtccatccccgagacccgactgcgttccttctccttgtcg

SEQ ID NO: 11979 - DNA, 1214 bp, Zea mays
agctcggtactcctgagttgaagacaatgcaaaaatttgaaggtgactgaaaaatataagacagggtgtggacaggaaatgcggtcataaaagttataataactaaaaccgctgtcctaaaaagatcaatccaaatcgaaggtattgcattcttttttttgcttcctttttatgtacacgcatatgttacttcttgttgctgctttcagacattattagttatgacatctctcatgttggtggttcaccattttgttaaatattttatttctctctcttgtacaataaattgtgtagccatttaccattttaactcttctggttgtttgttcctctggaaacaaacacatcaaacaggacgagtcttcctatccgctatgttgcaaaatagttagtgttgcataagtcccagcaacaattccacatttgatcattttatgtctcagagaataccacaaaggctcactcattttgaaacacactacctataattggtggatttgtggttagtgatttcctctcttcttaccaccaggacagagcagcttcaataccttcttgacacacccatgtccttgaagatatcatttgaaggttaatccaaagttatatagtactgcagtctgctctccatttccccctacatccatttttgcgtttggttttgatgtgtgtttcaaatattcaaatatccaaacctcatttggagttgtgataccagcaacctttgacatggattcaagatgctactggagtgttatttagtacatgatccaactggtaagaaactttatgatactagcatatgtgtgtaataatgagattactagaaatagcccattttactgaatatagaaatttcagttctattgttttaacacaaatttgtttgtgatgcttcaaaccgctaatgcattttttaaaagttatgcaatgagcatatcacataataaatgagattcttaggaataacccaagttgctaatgagtaaaatttcagctttgctttttaaaaaatatgggttcaagttgttcctaacattcggacaactgtcaaatcagatgccactgcacaaatggacgttgtagtgaccatactgtcacgagagctaagcaaactacagcctgcaagagctacacgtggtagcctatattcctggcttgctataattttattatttttcttttgttaatgagtgtagtttctctggcta

SEQ ID NO: 11980 - DNA, 218 bp, Zea mays
agtccgccgttcgggtcaactggcagctggctgcctggctataaacacccgccctcgcaccaccgcggcagggcacggcacacgtctcggcagccacaagaaaccacccccttccggcacacgggctcgaccacctgactccatcaccgtgcctgtctgtgttctagggacaagaagagcagagagatccaggagcgagcagaggcggggagaagagg

SEQ ID NO: 11981 - DNA, 251 bp, Zea mays
ggtattgatctctgggctatgtttttatctttctttcttttcctctaccactttttttcctctgatcagtttggcttcattattttatcttaacattatcataaccaatcctttctggtaaactgactctacaaaattttcttgaatgatttcctatcgtttacttgctgttttttttctcacatgattgatgtgattttgaataagaaaatagataatatattgatctgcttgatacccaatttcaggca

SEQ ID NO: 11982 - DNA, 585 bp, Zea mays
tggagccctaaatacgttgtaataccagcgacgttggtgctcaaaatctggtttagaggtgtttagttccagtgaataaaatataatttatgtcacatcaaatgtttatatcaattaagagtattgaatatagacttaattatgtttattaatttcttttcatcttttagataaaattaatatttatatgtgtaattaattgtataattatattttacttagaatttgtttggaacaactctaattaaaaaattggtgtgattagtggaacagatcattagatgctatagaaaattatagagcaaaagttgtaagcctctataaaacatttagaaatatcattttgtttattatatagatttaaaatatttttaaaactaattaaattgatattataaattaccgaagctggaaagctatccaaactctcccttaatattcataggtatcgataaatactaaactttgaggaattgatgcattactcgaaaagaaaactagccgggcaagttacgcccaccaccataccgtcccacgcggcctcccaaactaaccgtatcccccggcgaccgggaactgcaaccg

SEQ ID NO: 11983 - DNA, 519 bp, Zea mays
ctttcgttaaattttttttgaaagaaagagattggaggggattttagccctcaatcccctcccttccaaacaatggctaaataacacaatcacaaaaccacgagagaaggcatgaaggaaaccacaagcgcgccaggcatgaaggaaaccacaagcgcgccaaaaccacccccaggcggcagcgcccgtaggcaccaacccacccacagagaaggcatgaaggaaaccacaagcgcgccagcgcagcagtcggggagaagtggaagtggactcgaggatcactctcgctatcgactacgctatctcaactgccacggacaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagag

SEQ ID NO: 11984 - DNA, 710 bp, Zea mays
ggatctatgtgctttgtgcatgatgcaagacaattattgaaactagtgctttataggagtagatagatagatatttatttatggttaggtgagaagaggaggaacatatcacacactccgcacgtgacgcacgactatagttaaaacggtggaaacttatgctttataggatcagtgattaaagtagggttgtcaatcaggcggttcagaacgggtccctacaggtttataccttttcccacggtgtcacgggttcgggacctaaatatgtcgagtttgggacggtttttgatttctaaccacggttttatcacgggacccgaaacctgaatcagtcgtctagcccatcacttctacactcgcacgcagcccaactgacaacagtcaatagcccaagtgccctgtcgtcctgtccacgccctcagccaaaccctagcactcggtcgcgcacaggcacaacgcagcgcactcgcgccgtcggcattcagccgtcgcggactcgccgcccacccaggtcccaggctgggagagtggcagacacccactccgccactcgtcctcagccaccgaccaccgtccgtggttccccgttcgccaccggccaccgccagtccaccacccccccggcgcggcggcgcccctcctcctcctacacagcacacatgcgcacggcttcagctgcagttcatgaacacgactgaaggattgca

SEQ ID NO: 11985 - DNA, 196 bp, Zea mays
caagtttttaggcccacaaggtagaaacctgaacccaatgatatcaatgatatgggcccacatccgccgcgatgatttggtgatttggtgatttccatctactaataatgctcttttcatgctaatcctgcatataatccaaatggtaatcgaaccctacttccactaggttccgcgcataccctgacggcaagcc

SEQ ID NO: 11986 - DNA, 1500 bp, Zea mays
gttaatttttaagttgtgctataaaggggtactagtcggttgcccgtgtgttgcgatgacttacaacaatacacatgtaacttatcaacaaaaaaattaagattttttattaattatcttcgctctccgtataattttttttatttagctaaccgatgttattatttactacatccaatatgtcttggtacaacacggccaatgaagtgagtgattagaagatagttcacaacgactaactgaacgaacaaagattgtaaaatgatataattccaccatatagaaaccaaataagagaaagtttatgagctcaagtttctaaaataagtcacatgaactcaaacttataaaaaagatagatcaaaatatggagtgattgctaaagtcagatatcaataaaaactggatgtgctccatataattatgttactttgtagcaactactaacatttaaaaccaacaaataacctttcattttactgttgttgtgacaaattattcttgctccatccaattcagcaaccttaaacaccatgtagtccattgcgccaatatggtctcagaaacaacctaatgcttgcaagagccaagaacgtcgtgtcgtgcttgggccgtagcctcggcccgtagtgctggcccggcacgacacgattatatatttttttattttacaaaaaaaacgtatatacatatatataatttatattcaatattaaaaacatttgagcatcatattctactggttagacagctttatctagtgtctcccgaccttcttctatcagggcatgagttcgaaccccactcactgttgaaaccggtgctttaagtatagtatagataaattaaaaaagatacaatatttaataatttaaattggagagaatatcctttatctaaaacatctcgttgcacgaaacaaactgccggactgcgtggtctcgctgcgactccaggtccaggtccatatcccaaactgaatccacgtgaccgtccgtatcccaaccttcacattcggcggttcagatccaatccccgcacgagctcaacggtacagatgtctccaacgcactggaacggtgatcggatgaccacactcctccaaccaagcgttctgcttccgtcctccaatgcccacagtttctgagagaaaagaaaccgacagctcgacccggatcatctctgactccctgcagaatcaatcatcggttccacactatctcttccaaaatttcgttgataacacctggcaagttttttatcgcacctaaaattctatctgtctgttgtctggcgctgctgtatcactctgaatttttggttctggcccaaatcttgttctttttccggttcttctgatcccgtctttatcctctcaaatccactaaaccactccaaagatagaatttttctgcatccgaagcccagatatttttttccttcggtttgttccggcggcaggggtgcgaaatccctcaagctggcaaccccggcgcggcc

SEQ ID NO: 11987 - DNA, 1500 bp, Zea mays
aagtttattttttgctattttttttgtgtgtttaagtcaaacacctaacgtaaccgctgaaaataaaatagatataagaatggatgtatatatatgtgaacgcatggctgttaattagtgttgagactgaatggaataaaacgtctatcagagctgtaaaagctcatgatatcgcagggtcggctgcagctctgataagtcctaagggccacatgcatattccttgcttgattagcttgaaattatatatattagttgttagagagaacaggaaaagaaaggaaaacgacgcatgcaagcagtgtgagtgtgatgtgatccttggaggattccatgggataattacgttcggatcggagatgcggcgccaaggttttcactccctgtgctgtgctcattcattgcctgctagcttctctatttcaagtcataggacataggagtccatgtcagctgctgttgatctagctagagagatcgactaaagatcgactaagctgctatggattctatttttcaccggtagactcatgaatactatacggcctcatcgttatgggctcctagaacacccctaaatctggtcggtagatatacgatgaacaacaatatagaggaaacctatctatctaataactgcgttcgtacgtatatgttggcccgtccgaactcgttaaaacacacatcttctcttacaacattctcacgtgtaggcgatgtatcagcagaagcaagcatataatgtaccatgaatataatccagatgaatttagttgattctggtatgactaatccacatcatctcaacgacctcgtcttcgacccatcctgttcgctgttgcggccgttcgactgcgggtacgttacgcctagctagctaggtcggcactctgaattattgtctgttcctttccttcctatgagccaggaatgaacagtacgtgctttagtcgtcgttgctactagccccggccggcctcttcccaagctgcagtggccataaggagacgtacgcggcgatcaggccttccttatttttcttctgttccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgaccgtacatatccacgacctccaaaggccgccaaaacacccgatccggccagccttgtcgtgtcatcgtccagttagatgtcaactcccatctgaatctcctcctccatggcggctttcctataaatacgtcgcctttccatgttggatgccattccattccattccaagcagcaggcaacagcagctatagtttccaagggaaagggatacatcacctgctgctctagctctgctatagcgctagcagcaatata

SEQ ID NO: 11988 - DNA, 1500 bp, Zea mays
gccaggccaaggccgggcgggatgagaccttggccgctcccccgcccgttcgagtggtggctctggctccgtctggacggtgggcgagcggaaatggccaggcgaccggcccgccgctgaggcctggcatgtggcggctgcgtgccgcacggcaacaaacaacaacttggcgccgatcaggccggtgcgaaagcaatagcgcggtactgctgcctgctggctgctgctgctgcgtgcctggctggactgtacactgtgttggaacgagccacccatgtacacacgtaatacacacgaccctgataggacgctgcatcccgtctgttacaattcctttccttggctacgcgccaaggtctagcgcgcgcgtggcccacctcacacccccgccgcagaaaagcacttccccaattccaacgcctccggtgtgtcttccctcctgtatatgttttgttttgttggcgagcacgttcctgtcctgtgcgtgctaggcagccagcctcgtcgtcccttttgcgtgaaaaaaggggtggtgagacgtgagcctgcgctccctgcgtccctcggcgcgtgccgttgcccgttgccttcgcttcgtccttcgggcacccccagtccccacggccccaccctaccaaaacgaatagaaaaaaaactccagcaaatcccgccgccgttcgtttccaaaccctaattgtggatggggcccaccaaggccaggcccaaacagacggtccagatcagggcacagccgctcgcggacggccaccagccagcccgctgcccgccagctctcctatatgcccgcgccgccgcacgacgcgcggaaggacggaagccgtaggcagtcggccgcgggccacccaacccaccgcaccgatgacgcgggcggccaggccaggccccttctcccccccaactccgcgttaaggcgaagcgatcccagaaagcaatcacagctcgggcggccaggtcgccttcctctcccacccgcccgcgccgcgccgcgactgcgaatctgccttccccagtccgaccgcgagcgcgaggccgtggaagcggaaccccaaccgcggagcctccccctgttcgtctccttccctggcccttcccgcaccgcgccacccagctataaattgcgtcccctccctgccgccttcttcccccacccacacatccgacgccgaggaagtaggaagcacgaccagcatatgtcacagagggccagcgtcccacactcctcctgcatagccttcgcgctccattcccatctcctggtctccagtgagatgtgccccagctcctattggcagcaatagctattctccgccttcctttttttcttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcg

SEQ ID NO: 11989 - DNA, 487 bp, Zea mays
ctgcagttcagatcagggatactgaaattagtgattaaggtatatactccatccaatgtaggtcattttacgattctagctggtcaagcttctttaacttgacccatcattgcatgaaaagttacatagattggcaacatgtgcttgattttattagattcatcatggaaaatacttccagtacatataactttcattatttcaaataatatttttttacaaaagatgcaagtcaaagtatcaaattggagtcgatgttgctatcctaaatgacttacctttgggatcagagggggtgatctatacagttatcttcattatgtgtgtctgtgtgtgtcttgacaacatacaaactcagctttgtccctcctctgaaacatttgggatcagagggggtaatgtatacagttatcttcattatgtgtgtctgtgtgtggtttgacaacatacaaactcagctttgtctctcctctgaaacagctccacc

SEQ ID NO: 11990 - DNA, 512 bp, Zea mays
tgtgtttaatatttgacatctgattaaagaagttgcatgatatttgttaatcaagatctctattcctattaattaggaagtatataaataggctcttatgctctaaggacatataatgtataaggtagaatcaccctaaaggcatgcaaagtgtataacatagaatcatactttaaggtacaatgatgtggctaaggccaaagtgttgtgcataagtgtcatggttttgacccgacaatccttaattagcttgatgtttatagtttatacaccatgcatgatggagtaacaaccaaaacttagctttctaataaaacaactcatcagtttttatttgctgagatcagacatcagagtgcttgttttagtgtcgtacatccatgcatgtgttccttcatctctgatggttctgcagaaaaacagatttttggatctttctttcgttaggtcaggtgcgccatgcatgcaatgcagctgactgatgtgttttatgtgtgtgttctttcaggaaa

SEQ ID NO: 11991 - DNA, 1122 bp, Zea mays
gagaggtgcgggcgcgcggaagatttaggtcttttattttcgtcggccgtattggggccgacgaaaatagtggtcgtattttcgtcggcctcagtggggccgacgaaaatagttgacgtattttcgtcggcacggcttcggcccacgtaaataagacctattttcgtcggttacgaggccgacgaacatatattcagtattttcgtcggcctgccgacgaacatagcccccggcccacgaaaatactctttattttcgtcggtaacgaggccgacgaaattatcttacttattttcgtgggtcggccgacgaaaatatcagggcccacgaaattttatgcgtttcctgtagtgtgggttgagttgggatggtgggacaggtgatccgaagaaagctatatatctttttttttttgcgtacatgcgcgtgggagaaaaatctttggtttggatttgacgggagctgctggccatggattgtagtagtagtcagtacagtagtatagcgagtccacctctcctctccgtcgtctcatcttaactaacaaccaagcaagacgaagacagcgcccaagaaagcaaggcttccttcagcttgactcaaagccaatgcaagcagcatccgacgtcccatgcagagagcgccaaagtccaaggcgctacgtgacaactctgcatgaactcagctgttcaaacaatcattttattacattattacaatattactacgtatataatcgtgtgtgtgataataataactatattactcgatcggtctgctgcgtccgtgtagactgcgaaataatcttgtcattgcagcatccccgtattacctaaccagctgtacgtaccatatgcacgcagttgcttctcaactccgggcggcagtgtataagctgagcatatgacgagacacgtacgcaggccacacgtcctagctaggtcgtcgcagcactgcaggctgcagcagcgagcggccgggcagtatataagcatgcagcagggctgccccgtagccacgacccacacggccacacccaccccaccattcggttgaattgaattggtgctgtatgtactgtgctgtgttagttgcatcggttttgccggccggcaggccagc

SEQ ID NO: 11992 - DNA, 1500 bp, Zea mays
gagagagagtgagacaggatcactcggtagtcgggatcgcgcggcgccaccgtaccccgcccgggacatgtgcgtggaggggctagacgacgcagcagggacgctcgccttcggagaccacgagaacgacaggcgcgacggtgccgcggtgcgtgatatgccgttgactttttttcccttgcttgctcgtttgccgggggtgaaatttcgtgcctttgctctcgccggcgaccctccgtcctggagttccgtcgtcggccgctcaaccgcgaggagggaggtcggtcggttgcggagacggaaccgaattttctccttggtggtggttggttggttgcttccggccgggccacccttttcttgtccaaatgcaaatgcttcctctctggttattatttttttccctggtaaagcgtagtatgtaggaccaggataggttagctatcatttattgacgcgccagtagaattaaacaactgcccgtacaattcgtttttcccccctcgcccactagtacagtactgtaggtaggagtaggtcagtaggtgtgaaagagaggggagatgcwmtagcacaaatcgttcaacgtcagagtcaaatgtcaaaaaaaaaaattagtgagccatgttgctaaggccttagtgatgctaccagcactaagctatgtttctaagcatgtacgagtagacggtggcaaagttcagttggtactttgcttgttcctcaaagaggccaagaaggaaaaaaaagggggtcaaagaacaaggtcgagcaactcttctagtgatccatgttctgtatagcactttttatctagagctcttaagatatacataacataatgtcatctggtggcccgcggtgccctttagactataatggggtagctttgttcctttacctgctagggacgttgcaataaacaggaagtggattacggagtggcgcgcaagaatgcatgtacacgtgtaggctttacatggctctgctaattagctcagctgagacgaacagccggggttgctgatgtcctatcatattgccacagctgtttgctcctttgccaagtttatatacgagatgttataacctttttggctggaaggacaattgggtgttttctttatcatttgcccctctctagaaattgttacatgtagccttagctttcctgtccaataatgatttgcctcttgtcacttagctttaccagatcggacttctgattccacgtcgcgtgctagcaacaaccagctagctgtatcactacttaactactgcgtgctatctgtggtggcaacaagtatgtctagggaattccagttcttggcagcagggtgggagtgctggagtaggattttttattcattgcctgcttggaactaataacctgttcgctttaagggtttcttcaatcgaatcttatatagtgcttatattttggtttgagtggtttatcttttttccgccgggttctaatcctccttggataatgtgcag

SEQ ID NO: 11993 - DNA, 747 bp, Zea mays
taatatacagaacataattttttagagggtgatgtaaaggacagaaaatatttttttagaggatggaatttatgggacgctgctgaagtcagtctaagatagttccttataacacattacatattccatcacatgacattaaatagttgttaaactttatatgacactgtggtttaaatggttgttaaatagtcaaaaaagatttacgattgaagatcaattttatgtttttgggccaaatttataccaagtattttatactatgggttaatggtgtaaaggcagatcattctaatacttatatacctattgggtgaaattttttatccaataaaaagctcaatagataaaacatttaatttgtatacatattataatgaagaaaatatccataagatattgccatctccacgtgacacacaggccccccgtggatgtctctagagcgggacccttcccttcgtattccagccaagcagaacgcaggaatctccttcccacggatcactctgccacgatccgcgtgctcacccgcaaaactaatccacaccgtccgtcctcctccaatccaacgcacgaaacctcatttccctcacgaagtccccgctgctgttccaaaatttcactctctctcccgcccaccacccgtcccttatttaatcaccccgcctccgcactcaatctcacaccgcaatcttcaatctccccagcaatccctagcagaagccttccatcctcactcgctcg

SEQ ID NO: 11994 - DNA, 495 bp, Zea mays
agcgtcatattttctgtcatcagtgcccgatcagaagatgtagagatatgctgggttctgtagtttgggttactgtcgaatcatcgagtgttggctgttcactgctgtaacttaattatcatgatgcatatgaaatggcaatgaactctgttatcagttctcgaattttccgtttggatcccttcttgttcctctgtgcataatcattttatatttgtggggataacgggatgaatggtgagaaggatgaatcagcgttcaggccgagcgttctttcacaagtggtcgtgtaggcgtgctgggctgtcaactgggcccactggcaggctaatcttccccttgtgaatcgtcttgtactgttctcgtgctaggcagtgggctgcgaccgaatccaacataagaggaaaggggcgtttgctttatattcgttctaacctgcgatctccgtccatccagccgagaggtcgtgtgcgcgtggatctctgcgtggaagcg

SEQ ID NO: 11995 - DNA, 108 bp, Zea mays
ggtaacctcagatctgatcggtttttggatctctataagatctggggtccgtactaaattgtccacgcgtgtggggaaaataatgctgtctgttggttcatctaatgt

SEQ ID NO: 11996 - DNA, 495 bp, Zea mays; identical to SEQ ID NO: 11994

SEQ ID NO: 11997 - DNA, 1500 bp, Zea mays
gggctttgaacttctgtgatctatacttgagcgtgacatcagactcaaaatccaaataactgttttttagtcgraaggcttacatggaaatctaaaaaaaataatctatacttgagcgtgacatcagactcaaaatctaaataactgctttttagtcggaaggcttacatggaaatttaaaaaaaattaagcactcgtaatatatttactaatagtcagttactcgtgctatgctatagttgttatatatcatataaatatgtagtgaaatatttatttaaatataattattgttttataaacactaagttatgtgtggtatgatggttagcctaaatttttgaaacaggggagcgatggtgtccataaggcagtagctaagagagcgctgcacgggcgctagacgtcgtgtccacacagcgcacgacgtcgaggcggggcgcatgcggcaggtctagagtgttagtgccaaaggtgaaacgatggtagtactagttaaccacgttaggttcttaatatcatagagatagaattctttcacggtgctatggaacccgtttttagaagaactatttttgttcaccgcagtgccatttcatcttcggctgcatggcgtttctttattctaaattattacatgctaagtttaaaaataaattaatggacgataaatactcgaaaacggaagcagtatataatcacaacaaattaagtgtcaacttctggcgcagaaattcaaatgaaggtttaaactcgggccgcaagttgctcgggtaggccgggtgcgtgaactggtcagcacagcgtagctaaaatattggtgatgcagtccatgtacatacgtagcccagtgttggatgaataataatcaacgttagactaccgtggaaggaaagaaaagaatgcacggtagaccgagcctgcgtgcacctaacggggggcaatgtcgtcattccttaatagccaagcaaacgagacagcgaattgaaacagcaccgcagaccaggaaaagaccgcaggcattgctaatccaagagggaagacgacgagcaaggacacggccgtggtagccgttccgtttcgcttggggtggttgggtgggtgaggtgggcccgcattgaagccagaagcgaagccaccggtggtggtgcagaccgcagacctgggactctgggagggaggcgagcatcttcccctggcaagtggcacacgcgcacacagtaggcacaggtttggaagccgcgtggagactggaggggaaggtcccgtcgtctccaccttccccactggcaccgccccccagccgagccgccacagcccacagggcaggcagcccgtgcccggcgtcgttttcccggaccccgcgtgcgtgctaacattcgcacgtcaagtccgtatttataccggccgcctacctcccggtgttgctccagttcgtggagtggagtcaccacagaatcaaagaaaagctttcccccgatcctctcgcggacaccagcg

SEQ ID NO: 11998 - DNA, 607 bp, Zea mays
ccgtcactcataccttatccaaatgcaattttaagattgtagataacaaaatctcaaaattctacaattccatttcataccctaaaattctagaggactctagcacgcggtcataaaaattaaaaaaaaatcacgcgtttttttttctcgagggaaggaacgaatgagaacttgcccctttatccacgacacgagacaacatgttcactgccgtatttgctttcaggtctagcagatgtgcctggtgcacacatccccgtgtgagacgtgcttcaccacggacccaaaggtctggcatgaagatgaagcaaacagcccactaggcactagcaactttagcccgccaaatgcccatcacggtctcacccgcatagggccttccaaccggtcgaacatctcccgtcataatgggctccacggcccatcacccccatgccccgtctccaaggaaagcgaaccattctgatcctgcaacccgtggcgccgccgccgccgcatcgcattgcccggacgccaaaacctagctcctgaactctcctcggctcctcgcccacctctcgctagccgttcccgctctgcagtctccgtggccggacgccgcggcgac

SEQ ID NO: 11999 - DNA, 1500 bp, Zea mays
tgattcccatgattaaatatatatgaaaccttaacccaaatgctaaacaagtactacagagactacctaaacttattttaatagcaatttccaggcgccatgttggttggactttggacgtggccggcttgtaatttggcaattggcaacggcgacagaagcatggggattgggggaaggcagcgcgggcagtggaaacggtcaggagagggatccttccagttccacttccagacaaggatggtgaggtgtgacaggctgcccactctcgaatccagctgaagtctcaccccacatgtgaccggttttggtttggtgcttcttgtcttgaggcctcttggctcttgaccacttattatttatttatagtagaagggaaaaggactatctatgctagtagaaaatattcttttgggatatcctttgcaacgtgtaggccgtgtgcgtgcgtgcgtgcatgtcaactgcgaaaaaggagacattgtcaccgctgttcaatggggggactataggggagattcaatcattcatgttcttgggtccattgctcccccccaccatgtgagtaagaagcaaaagcaacgaacgtctatcgtgtctgcaggcagcacgcaggtgacaccgattggggagatgcatggcaggtggcagcatagctcttgtttttggttggcatagcggccggtatagcacagcacagaagggtgacactatgggtctgggacagagtggttgaagtaaaaagtctgcatgtgggggcttgtatgtaggtggcgctgtctatgatcaaatcttttgactcacaccgacgttccgcgcgtaggcgtagccatctcttgagtttgaagtcgaagttaagccgcgtcttgcagcactggtggaacgtgctttagcatcttcctaaattaaaatcaatcaactccatggctggctgggaagtcacaccaatccctatacatataataatgacaccatacgttgcgtttgtcctccagcttggcgcccatgccgttgtaggtgcacacggcagaatgcggttcggagctccaacccaaagcaaaagatccggtgcgagcgcgaagcgggcattccatttccagcgacgctgagcgcgacccgcgagtggtgcccggccaccaggccgcacggcaccaccgacaacctgtcctccggccggacacgctgctgcgcggggcccgccgcggcgccgccccagctgcacgcaacgcaactccagccgcgcataaactcggtcgcccccgcacgcgtcgccacccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgcc

SEQ ID NO: 12000 - DNA, 506 bp, Zea mays
ccacgtgccaggatttcacaccatacaaaaggtcactgcagcaattcggatgctagcgtacggaggtccagccgacagcctcgacgagtacttacgcatggggcgaaagtactattcttgaaacagttggccatttcactcggacaattgtgcagttgtttgctaacgagttccttcgcaagccaaacaaacatgacatagctggtctcctacaagtagcacagcaaagaggttttcctgggatgctaggtagcatagattgcatgcactgggagtgggaacgttgccccactgcatggcaagggagttatcgtggccatttcaaaaaaccaacactgattctcgaagcaatagcatcacatgatctttggatatggcacgcattttttggtttgcctggatcttgcaacgacataaatgttcttcacagatcacccgtcttcgatagcatagccacaggtgatgttcctcctgttacctatgaagttaacggcacacaatatgat

SEQ ID NO: 12001 - DNA, 97 bp, Zea mays
cctgccgtgcgtgccgccgcggtcgtggccgtgggcgccgcagcgcgacacgcagaaggacgccacggggacgtcggcggtcgtgagcaccgcggtg

SEQ ID NO: 12002 - DNA, 627 bp, Zea mays
ggtttgccccggcggtgctaaatgaccggctaaccgaacaagctagccagcccctcagggatgagtggrcatcataatatcataatttccctccagtgctgtgcaggttcagaatggagtcaacactcggttctccactattgcactcttacttcaatctcctctctcacacacaccacctttgctagtggcaagatccatgacttctacatttgtccttggctgggcaccactgatgatcaggagaagctataactaccggcttaggttagttgggcactacaaggttggctcgaagtcacaagtgggttagtattcgccctcagttgaccacaagctcattcacaagtgagacagaaatgggtgagcggcagcgtcccggtgttgtgttgtgctaccacttggacggcccgatcctttcctgctcacgcgttcgaatccacgtgtcgcgcgctcatgcccgtcgttctcgtgccccactcccccctctctcgctgactcggagcagtcaacagcttccccaatcccacccggccaccccgcccgccccagtctggcagcctgcctccatagtccatctcctctccccctaccgacaccgatcccattccccaggcccaagcgccc

SEQ ID NO: 12003 - DNA, 234 bp, Zea mays
ggtaagcccggtcatttcattgctaaatgtccattatctagtgatagtgacaggggcgatgacaagaagggaaagaggaaggaaaaagaagaaatactacaaaaagaagggcggcgatgcccacgtgtgtcgggaatgggactccgatgagagctccaccgactcttcctccgacaaggatgccgccaacatcgccatcaacaaaggccttctcttccccaacgtcagccacaa

SEQ ID NO: 12004 - DNA, 1500 bp, Zea mays
gcttagatttcttgcctggcattgcgtcactgcatatgtttggttgcttagctagattacctcgatttctgtgctagtaagattttctcttgtgttttcttgttgtcccgtgcggccaaattaggtcgtttgatctagtaagattttatcattttagcctgatttaaagggtgtttgatttcacctaactaaactttagtatctaatgaatgataattacatgtattaaacatggtctaattataaaactttgaatgataattattggtattaaatatggtctaattataaaacttattatacatatgaggactaaaagacaagacactttattaaacccattcaagtctatatttaatactcacaattgatatttaaatatttgacatgatataaactgaagtaaactttatttaccaaaggcaccccctttagctcgggtggcctcacaaagcgcgctatgagaaacctgctagaccaggcgagccatttttgctacaacgcgacatcaaggaaaagagccatttttgctaaacttaacatcaaggaaaatactgtcggtgcaggaatcgagagaagcaaaggtacgagaaccaaacagccagcagtttgtcggttggctaggctgcaaagtaccaggcggccctttgtgctgcccagcagcaggaaggaaggacgagtctgctttgctggagaacaaagcagccgctgcagccccctgctcatgtgggcccctcggtggcgcactaccgagcgtaatcgctggcgtaatcgcgtctcctgatctcttgcggtctttccggacaataaaggggtgttacttggagggactaaagattagtctctagtttttagtcttatttagttctttttttatcaaacactagaactaaaatatgaactaaaatgatttagtctttagtccttcacatatgtgctaaaataaactaaaccatattaattccacatctaccagttcaattgtactaatagcagaagaatgttaaagactattttagtcttattatgagtcatttagtatattttttctatttttagcctctacaaacaaacatgttagagactaaattttagttcttagactaaagaaaccaaacatgacaaaaacggactcgtgtgaaaagtaagcagaagcatctagacgcgcgggggcggttggggcctcgctgaccatcagaactgacaacagcgctgccgcacctacccctctccactacgactccacattttccaacggatttttatttttctaagaaaattagtttttttagaaaaatagaaatcacttggttgcactaaaaaaacaggcacactcgtcactcggtcgccgcgcgacctcccagttcgtctattaaaggggaaccagtgaaccacccgatgcaacttgcgtagagagttgggcgcagagaatccccaagcaaacaaacagggtagagggagaggagaggagaggagaggagaggttgggtctgggacacc

SEQ ID NO: 12005 - DNA, 596 bp, Zea mays
tgatgtccacttgaatctgccttccggaagtgttgaactttttttgttttgccaagcgacaactgcgtcggggaataaaatcaggaggcatcagcctagccgactgtcgtctctgtggcaccggcggaggcagcagacactccaccttctctgtaacggaagccacaaaggactgaatgggggcatcatcagatcccaggtccggaattaattcaatgtggtgatccactgaaggtgccaaaactcgtggacaatcactctgccgtctgcggtatactttcaaggttgttactttggttgccacagcgggcggcgcatcaagacggggcgagactgtcccagacggtcccagcgactcagttttgttgtcttccatttaactaatgtggcctactataacttgaaccactaccctgattgtatctgtgtgccttttttagcagacgtccaccgctgcacaacgagcggataggtcctctggcggtaaggtgagaggaagcccttgcctgttgcgtttcggaatcaatgatgcctttgagttgaacaggctttcgtgtctttgtgtttttcccttaaaaaattcgcagccatgggag

SEQ ID NO: 12006 - DNA, 1297 bp, Zea mays
tctctctttctgacctttgttctttgagatacatataagcagttaacgtcggtgcaaagcacccggctgactgaaaagaccaatttttgttcgcacatttttcgagaacacttacacacctgcaccattgtccacaacatagaggacattgccaacttcctgtcatacaaaacacaaacaaatgtctttggtgagattattcttttcctaacaatatagatgtggtgtgtatatattgccaaagaaaactttccaaatggtcataacaaagtagcacacccttgaaaatggagtaaaggattcattcactgcatcaaaaacaacgtagacaataccacgctataacacgcaatcttctaacaaaatatgatccaaacaaaatacccagtgaggccctctattcaagagatgagaaaaagcagaaatacatacacctcgcaggcacattgtgagaaacaaaactacatgagcacataatgatagtagaaaccgtaagcctgttcgctgaaacattctcctgttgttgatatctaccagacggcctcgttctgctcttgtggatttctgaaacattctcgtcgtcgcgattgacttgcaaccaatggctccgacacgtcaccaatcaatgctcagacagcggaggtggtgagacggacacaaagcaaacgtagggctttatttgttgctgcagttacctagatgtgagtaattaattagtgtggatttgctaactggttatcaggcattttgatggacgcaaagcaggctttggtcgtctgcgaatgcgatggtgctccggaatccggattggcaagatatcttgtccggtgaggattacatgatgacataattattattgctcccggggtgactataattacttgcggttagtttttactcatctgtctctagatctacacccaatttgggtgaccaatttcccaacgaagaaggaaaatacggcaagggcagcagcaggcccgcgtatatttattttcttttgggaccaacccaacccagcccagtagtaaagaaacccgtgaggcccacgacacgtcagccaataaatgagcccgcggtggcacctggcactggcaggcagaggctcggtgtctccggcaaccgggaattttggcatgagaatatgcggccgtggcgtggcgtcgtctgtgactgtcgtcccgtgccctcgcgtccctttcccttcttcccatccacgccagccaagttcaccgccgcgctcttcggcggcaactactgttggatcgtagggcgaaggaaggaaggaaggggagcc

SEQ ID NO: 12007 - DNA, 146 bp, Zea mays
agtacgcgtcctagtccgatccgtcgccatcctcgtggaccacggcctcgcgtcctggtcggcgtgcgccaccgcctgctccagtggacggcgctctactcctaggtgtcgccgacgaccgcgaggcgctggcgtacgcggcacgg

SEQ ID NO: 12008 - DNA, 1256 bp, Zea mays
tgtcttcgggctcgctgtctgttagaatcggatgctgttgctgacaaatcaagtgatgatctgtcggctaactaggctgtgccattgctgccatttgattggaatcccatctattatttggacggatcaacctccctctcttcttgtttcttgacgtcgctttgcttctggaaaatgggaggagagacactggaggtcttgcatgggagaggtgaagaagaggcttgttttcattcggctattcttagttgtgtggatgagagggataatagacgggaacatgcatccaacgtacataaattcgagcaaaattagagatgcagcatcccccgttttgtccggattttaacagttgggcctaactaataagtatcggaggcaacaacgcccgctgggctgcggcccattaacatagcactagacggacaccgccgcagtcagcgttcagccggatgcagtgcgatcggcttcatccgtttagtcccacctcgcccagccaaagcagcggggaggcccggactcgctacaaaaggagacggaggttggctgtttagagcatacctttctcggccttttggctaagatcaagtgtagtatctgttcttatcagtttaatatctgatatgtggaccatgtgttcacttcgatattaaatttattttttgtgggggagggtccactacagtggcttgccactgggcccctcgagcgtcgctcggccgttgcactactggctgagcctggcgcaccccaaccaatccaattcgagattttttattaatattttttacgacatataagcagaagttgaaagtcttagtaacagatccagaggcaagggaggctgtgcatctcctgtaatcctgtcttacaatcatcgaatgtctcgttccttcgatactaccagccccaaggcgcctgacctcgctctcttccccttacccttcagctgtatgcttcgatcgagtttcatgtgcctgtccaaccctgatccaaatcggactcaacaaactccaggaactacatcctcctgtgtcgtatgcaaccggcaaatccacttcattccaagcaggcagagatcaccagtgccccttcattctcttcttgcatcccaaacacggcagtataaaacatgaatgcaagccacttcattccagctgatcacaaatatgaatgcaacagatacaggcactgcaaggcatatcgtactaaatttcaaaaacattttctcatctctttcctttttatcttaatac

SEQ ID NO: 12009 - DNA, 382 bp, Zea mays
tgttacctgagttgtctaagttggatgaaaatgtggtacctgttggcaaaactatggagtgtgctatctagcgagtgtgagtgtggatgtatttagttttgaatggcgagtcctcatcacaggtattcagcttgtagtcgactacaatatcgttccagttttgtggcatatcaccttaataccaataattcccaagccagagcatgtcaaagaccttcggtcgatcagtttgtgcaatgtgatttacaaaatagcctcaaaaatccttgcaaatagattgaaagatatcctcccagatataatttctctaaatcaaagtgctttcgttccggggaggatgattactgacaatgttcttctggcctatgaatttacacacttt

SEQ ID NO: 12010 - DNA, 299 bp, Zea mays
ggtggattgcaaccctcgtccgttggggatgccacaacgtggagtagggcaagcgttgttcttgcccgaaccacggggataaccaccgtgcccatctctgtgattgatcttgttggttgttttgttttgttgaagattcctctctagccacttggcggttattgggctaacacttaaccaaagtttttgtggcttaagtttttaagtgttacaggatcaccctatttcaccccccctctaggtgctctcaattggtatcggagccgttctcttcacaaagggactaaccgcccgaagag

SEQ ID NO: 12011 - DNA, 1239 bp, Zea mays
gcagcatgattatcgatatgagcctaaacctagctggtaccgataatggatcacattaagtcgaatttcagtcatattttagttggcaattcaaagaaacaaatgtgacaagcagcatgtgaaggtgccgtccattatctatgctaaactgtacatacgaacaacaactagcatggccgtcacatgaatgaaaaatgttaacagagttattagattatatccagaggttggtagagcgttcgttacaactagcatgatcactccgccttgagtagaagctggctaaaggcagtagtgacttcgatagacataagcaaaattataataaacctggcagtattataggacaaaaaaaaacaatataatgcatgataaaacggttcagaataaaatttagagaagctagggataatgtaattaaaaaatggcagtggttaatattacacaatatatataaattgcatgcccacatgatagggaaaagagggaaatttctctttctacagtttattcagaaacgcaaaaagaaaaaaaaaacaaaatcccttctagagagatcccagactcccagcatacagcattcaaggaagcggcaggactcctgctccttgctggccttcactaccttgcaggtttcttgtacatgtacgagtacgatcaccggatcatagccttgcaatgacaagaatttcaggcctaccacgtgcaacaaattaatcctcggtggtacgttctgcatgcacagtattaaagccctgctgtattaggacaataaggtttttttatatcaaagttttatctgcgttcgataaattatagcatatgaatgtttcattataacgtgaaaacaattaccaatactctgtaaaccataaattaaaataccaatgaaatcatagaatacatcgtaactctcagttagaagtaagtattcagactgtgcttttctattccaggattgtttagcgctcatggaattgttagtgaaatgtgcttgtcgtccatcacactctacatcccgcccaaccccagcatggaggcctcgcgcgccgaggcgcagctcgtcatcttctccgccatcgacgacctcgtccgccgcacggggctcaagcccaaggacatcgacatcctcgtcgtcaactgcagcctcttctcaccgacgccctcgctctccgccatgatcatcaacaagtacaagctccggagcaacatccggagcttcaacctgtcggggatggg

SEQ ID NO: 12012 - DNA, 1315 bp, Zea mays
cgcttgctttgctttgcttgcatgcatgcattgcgcgcgcggcgccagtacgctgacagcggtgccgtcccgcgcgaatcagacgccgctcgccatcatggtgtactagccgtgtgcccgtgcgttgcaacgagagtacgttggaatgagcatcgacacatatatgatcggatcttatattcctttggggtctggagaaagtttgctcggaagcccagcatacgagctggcagtctggcatgatacaatccttaattccttactaaaacaaaatagtaagacatttgattgcatcatactcgacaaaattagtttttattagttgcaacgtcacccaaccgaacgtacatgtatacaatatagctacgagcgcgtgaaagaaagctttatctaaatctaaaactaatgttaatttaggacaaagagagtagtaaataaacattattctttagcttgtgaacattaaaaactaaagtgttaggggtgtttgatttctatcttagtgactaaagtttagttacttttaggggtgtttggtttatatggactaaatcttagtccctacattttattacattctagtctctaaattaccaaatacagaaactaagactttattttagttttcgaattgagcaatttaggaactaaaatagaataaaattgagggactaaacattaatccataaaaaccaaacaccccgttaattcctaaaatactaagtaggtgtttggtttataggcactaatttttagtcccttcattttatttattttagtccataaatcgctaaatacggaaaataaaactatattttagtttctttatttgataatttacgaattcaacgaaataaaatggatggactaaagtttagtctttataaaccaaacactcctaaatgaagtgattaaaataggtcttccaaataaaatttttaggaactaaagtttctccttaaaatataagaggatggctgaagaaaccaaacacctacttacattattttgaaacatattagtacacggcttaaaattttcgtgcaaccgaggagtgaaaaacagacttgttccaacgtcccttgcaaaacagatcaaaatcagtaaaacgacggaaaagaaaagaaaaaaaacaggaaaaggccctcacgtccgtcgctaatcccgatcccgatctccaagaaaacccacctccccggctgtcccccactcgccgatccagatctcttccactccaaccggacgcctccgctgccgctggcatcggtcaagccacacgcgcacgccgctgaggaacctggagcgggcgccggca

SEQ ID NO: 12013 - DNA, 1500 bp, Zea mays
ccgtctttggtagtggtgacttggtgttggtgagccactggacctctcgtttcccttcctgagttgagtgagttcctactcagtattgcttattgcttatttgcacatccggacacgtaaagtatatataaaaaagcaacccaaacaattgatgattgaacattgagtcgaatatataacattttctaaattaggtaaccacttgtttaagtcaattttacgttaaattgcaattattatgctccaatgatatttatatgtgccattagttatacatttgcacgatttaattattttagctgatacaaaaaaaattagtgttatatctggccctactgttagagagatcctagctccgccactggttatgcccttcatgcaaaagaaaacaaagcttggtcagcaggccgctttgcatctgttgcttttcaggttaccaagcatttcaacttgtgcatctttggcacctagttgtacttgtaccatcttcacccagtcgatgaaatcaggctcctagtgcagtagtatgccatgatgcctctggcacctatctcactgatccaggtttggttctgtgtacgtggaggtgtatctccatgcaagtgtgtgtaagcaggccagcagcagggaaattgaggtgacggtgctcaatgaccatcgacattcacgaatgtatccccaaactaggacctgttgttctcaattctgttgttggtttatgggctaggcccagttaagaaatttatttaatcctaaaaatgagaaaagcccatatatgacaaggaatggtggaaccaatagttccatattgccagctcaaatggagtgagactagtttatatgtggatgcttccctctcccaccaagtcatggttgaggggagaaagaacgaagtgccacacacgatcgctcgtcttgtgggataggaaagggcgcgggtgcatgacatgcgtgtgaatggtccaccaaagtctggcccctcaccttgcagtctccctcaccttgcagtctgcgcctttaacgtagcgcgagcctatcggttggtggatcacgatcagatcggatagaaagtccttatcggtttgcggatgcttccgtatataaggcgcctaacaaaatcatcccaacacgagttaggttttttgcctttaccttcttcttacacacatctcattgaccctaccgcttccacgtcatcaatcaatatgtctaattagtacgcatcatcagatctaatctcatattttagtttatctatttttatagatgtgttctatactgcttactagcctgttagagaatatcctgctagtttattcatggttgctaatgatttaatctggaatatgtctacttattcaacaatacaaaaaaaatcttattatagacaacttcctggtttaactatggctcgttttgtcaatgcgctgaagctagaaaaattctcttctatgcacttcaaaaggtggcaagccaaggacatgctctggcttagctgtt

SEQ ID NO: 12014 - DNA, 134 bp, Zea mays
actgcagtgaaagaaggaatgtggtcaaaattagggtgaagcttactgcatcttccagtaaagcatctgatgctgaccatagaggccattctgatggcgcaagaaatgaaaatgaaccgggtcaatgcagctca

SEQ ID NO: 12015 - DNA, 755 bp, Zea mays
ctgcagttctcgatcgagagaggccctcttgaatctgaaagaggtcgagaagagccagcctgcgtgtcccaggagcgtgcgctcacacacacggtcctcatcaatgcccaagaaatctggagagacacaaacaaacgcaaagcaattactcacttcatgagcgccacagcagaaaaggagtcctcaagcagtacgtcaaccggccgtgttctcgcacacgcaaaagcagcgcatgcaacaaagcaaagatcacacacccggagcgaagagacgcccattcatgtgatcacctggctgacttttgcattggaaagctacagtgcgagatcaaaagcgaacgcagcacagcacaggccgggggagtggcttatatgaggtcatgcagtatataagcactcacatgcagctagctaggtagagcacctgtgcatcaaggtaaagcagatggggcctgctctgctgcctgcctgcctgctggcatgcgtgtacgtcctagaataaaaggaggcccgtatcgtattagcagagggttccagggagaagagaagggagggcgaggccactggctgtgtaggcagcagccagccacacagacacagcttcgttcccatctcttctcgttcttcatcacctacttgcctactatatctactagccacgctagctagactagccttagacgtggctagctcactagctgcttgctaggtgtgtaccgatcgtccgaggtaggagacacagcacgcagcaggggt

SEQ ID NO: 12016 - DNA, 606 bp, Zea mays
ccaaatgatccacctgattggtctttcggggcatataaagtcagtctcatccagagcatcacgagcttcaccactacaaccatctgacattcatgcgcggatccatccctctatctttgtttcgctagctgccctacctcataatggtgcccgtgccggctcgatggtggactcgggaatggttaatccagatgtagagagctccctaaaaggaaacctgttttcatcaaagacaacatgtctggaaatacaaattctgttagttggtatatgaaaaaaaaactggttaataatgtttggaaacatcttaatttctataaactagttttagctaggggagctaacttcttaattgttaagaaactaataatccaatttttataaattaagatataaattggtgtgtttgaaattatcttaaacttccaaatacgatgtagcacatatgaggaattgaaattgtgagaaaacctaacaaaaaagtacggaacggaggggagagacggagatagtagtgtcatcccgtcttccctcacccagtcaccctgacgggacggcaagcggcggaggcgctgtcatccgctggtccctttcctttccgcgcgc

SEQ ID NO: 12017 - DNA, 328 bp, Zea mays
atgaaaacggcttgggtcttcgggggctagtaatgacaattgtacagatatgggacacaacgatacatacacttgtattttacggtagagtttgttagcttgtgtttagggaataaaaacataaatagatacagattcttttcgcactgcggtatttttttaatccctgactatatgttaaccgtcttcatttacttccagctgcctgagggtttagctgtagcggtttgcgctgtcagaatttttacattttacagcaatacgaggcccagttccctaatgtagtggttccaaaccacatcgaattttgttgaacatttattttcgg

SEQ ID NO: 12018 - DNA, 113 bp, Zea mays
gccaccaccaccagcaggtcgtcatcaggttgcggcccctactaccggcggtggtcgccgtggctcgtctccggcgccaccgtggcctgcgtcgccattttccctcgtcacca

SEQ ID NO: 12019 - DNA, 419 bp, Zea mays
tgtaagatcatggacaacggaagacttcacataacacatcatctagattgaatggttattatagagggtgacccgtcaaaaaactcgctctttttagtgtgaaatgaaaagataccgtaagatataagatcactttatcacacttcagctatccttaaaatatgaaaagtttagcaaatggcttcttctgttatcatatctcttttcctgtgttctgattaataatagttgttagttatcatgataacaatcttatcaggcttaagaaactgacatgttctcaacaattcagtctgtggaaccatatcttttaggtttcgaagttaccaaatgaaagagaagctatttatggtgcattggacaagtggagtgcttttgaacctgaatttcctattatagcagcagcaaaagctttgggg

SEQ ID NO: 12020 - DNA, 1500 bp, Zea mays
ctagaggtggaagggggtgaatatgcgaaacctaaaaattacaaactttgaacacaaacttttctccgaggttagggctagaacgagtattaagaaaatcggagtgccaccacccccttcgcgtcatcgtcaccgtcgtcccctcccttcccttacgtgggattgtagcatttgcataaaytatatgctagttttagtaaacacatgagagactacactgcgaacatctgctcgattgcggtctctactttgagcmacacacaatatcaacttgtgtaacgaagttacctatgcattgaacatggatccctatgttattgggcatatttcactctttgcttgtatgtttaatctaatatcacgagcagtaattgcatatacagacatatatgtcaccataaatttgttatgttgttgttttgattaaattaaacaaaaaatactccaatttccaacattcaagttatttatatcatatattagccctggtttttcttgaaaaacaccagacctaagaggctaagacacactgttttgatttgagtgcttgtgaatcaaagtttgcggcagccaaacccaaacccgggacaatcctgactctatggcagtccccggttccggatccgaagccgggccgaatagtccaattccaataggcacacctcctcctcacgtgccggtgccgccggctgcccccaagacaacaagcccaagcggtgggcagtacacgcgacgatcctgcccgttcctaaccatcggccacggagccgagagcacgtacagtaacacgtgtctctgactcgtggcccagtagtacctagaggccccggaagtcagtgggacagagttaggcgtgttcgtcaacacgacgggcggggcgttacgtggcgtgcagcatcgacgcggcgcggcagtacaccatccgtgtaaaacacgagcgacaggtacctcaccgaacgtgccttcactgacatcgtgggcgcccgagatccagacccacctgtcagagcacgtttggtgacgccacgcttgtttggaaaccgatcccctcccgctgccttgcagacttgcagtgcaagagagaaggccgcacgtaccgctcggatcttcaggtctacagattacaagtacgtaacagccccctaataaccaaattgccacgccccgcgccgggggcagtctggggaaaatgggagcggtggcagaagggtgattggtgagccacgctcgagggcacaacggggagagcgcaacagataaatcctctatttggacccgtcgctgcttcccgtcgccattgctgcctcttctcctccttcctccgtccctccctccctcgctctcccatcctcctctgttctcacaatttttgcttctgaatttcctgccggtgtgccggcatcttctttctactgaggcgtagaccaaggaggagagtaattggcgagcggttggagaacgaatacgagacggctccggcggccggaggcccattttttg

SEQ ID NO: 12021 - DNA, 201 bp, Zea mays
ccatgaaaaatagccaccgatgaagctagcggcagcctgcggactgtagaggcagaggagggctcccaagtccaaggtggataagttttctagacacgcccttttccggtttccccattcccacccagaccccactaccattaccaaccagagcgacaagcccgaccgcccgcttccttgcaaacgaaacaaaacaaaaca

SEQ ID NO: 12022 - DNA, 52 bp, Zea mays
ggttagagaaatcgctgaatgacatgagagttggtgcaaatcttagtttcga

SEQ ID NO: 12023 - DNA, 247 bp, Zea mays
tagtggaccgtgagagttgagccaacagtgttcggctggcggtagtcgccgcaaaacggaaatctttcgcctccgccccgctggccgctgccgtttcattcactttccaatttcctttcctcacctccataaaaaaactcggccacggttatttatctctttcgctccgctttctcaatcactgggcctgggggagatcgagacctagagcggaggacgggtgggcggcgctgagggccttaggcga

SEQ ID NO: 12024 - DNA, 1500 bp, Zea mays
cgtcttcgctatatgcgagtagaatgacaggctgaattttcatggactctaggtatctgcaaaaaggattcacatttgaaataatcacaactttttggttgtgttggatgaaagatgcttattagtagaacaatatgggtagactttttggatgaggtaagcctcaattgtatagaggtaatctatcaaaaggcaacacagagaatgtgtcctcttctgtttttttactcagattgtactgatagtttattttttagttggacatttgtttttgtcaaacattttaacaatgattcttctgtgtggtttataatcagattcaccatgctacctgacttttcttgttttaagttacaaaatccagtttagtgtctgatgaatgcagtttagtctcgcgaagtcttaccaaggttcttgtagatttatgggttggcctctttgatctaacagtagatctgaggagtttgggaggtaaccttctaggctgaggaatttaccttgcttttttagttaattaacactgaattgccattggtatgccatacccccgatgaattctgagaattctatcgctgatttagtatcaaatgcagaatattggactacaaataggactgaatgactaatgagtgatgactcttgaattgagtattttgttgcagattgtgcatgatacaaaccccatgtagcaacattgagtcaatttttaggactaatgcaaactgtaattttcaaatcctctgcactattatttttgccttgtgatgtccagagatgcgggatctagtaaaggttaagatcttttggaaatgaaaaatagatcacggaagcgaggtgaggcgatgacaaagtcaaaatcactgctgctgcaccttgtgatgaattatcggcgcggcctagcggcctaaaaaaacattgtttctacaagaaatctgacgcacctcgcacctaacagtagcactcgcagccacagcccacccccaccccacgatccttgtcccacatggcagacccctgcgtcccgcgtacgttacgtcacaaaaccatccagaaacgtcactattgatattgtggatgggcaggcgcctgcggggtcgtcacgtgacgctcgccaggagacgtccacccggcgtcccgcgacaggccggcaggcgggccacgccacgtgctcgaccccatcgatattatccacacccgtgccggccgcgccacgtcctgctgccttcagcgccccgcaacccgccacgactgatgtgcacggaccacggagcacacctgcgccaccactcgctgaccccacccgcatccgtactgcagtccatgagccgggtctagggagaaccagccgagcccctgactgatctataaataagcgctgcctgctcggcatcgtaccttcttctcgaccagatccggaagttctgtgggtagaggactagagactgcagatcgagggtctggcagcgggccgtggcagttgggtgattacgacgaagagag

SEQ ID NO: 12025 - DNA, 89 bp, Zea mays
ggtgagtgctccctgtttttccgcttgcagtcttgtgagatgggtgattccgttcacgcgtgcgtgctcggcgtaggtatcggcacctg

SEQ ID NO: 12026 - DNA, 105 bp, Zea mays
ggttaggacatcaagagggtcgaggggctgatcgagctgcgcggcatcgagttccggtacccgtcgaggcccgacgtgaccgtgttcaagggacttgacctgctg

SEQ ID NO: 12027 - DNA, 296 bp, Zea mays
caataccaaagacgtggtgacaaaactgagagcagcatgccagcatctacgccggaagccatcccacggtatctaacctcgcaccgtcttgttcagctgctcaagctcgtaggatacaacggcaacgggtgacgtccgtgtattttaggacgcatccgctagtgtcgtccctcccagcatccgcatccgcgtgacacaattgttcacttgttcttggtttcggtcttacagaccgtcaccggcaggcagcagccttggcgggttggtcttgtgtcattgtttcctggctgccatca

SEQ ID NO: 12028 - DNA, 273 bp, Zea mays
gctacagtaaatcccctgtgcacttataatattcacgcaagccatgcattctatttttctatctattgctgttagaagatcagtaataattgcaacactgcttcacacaattagcttcattctgttcttttgcatggataatcatagtccagcggggcgtaatatccatttgaataactacttaggcttggcatggcattagtttgtttttcttcttcatccttggacttcgattgatttgatgaattattgttatctagcagaaatgactcg

SEQ ID NO: 12029 - DNA, 271 bp, Zea mays
ccgatctgcgggggccgtgagtcagccgcgaatctcgccgcagggactagagaagctgttgttaaccagcgcgcgatggataaccggataagtagatagtggccgttattactcttggattagccgcagttactcgcagtcatccgatactccgatcccgttatataaatagacgcccccttggccccgtcgcctcatcacgaatcaccaacaccctctcctccaccttccatcccgatcaccgccgccaccgctttcgttccacgtcccg

SEQ ID NO: 12030 - DNA, 1380 bp, Zea mays
gatcttgggcgctggctgctggtcttgcggagggaggaggagggcgctggctgctggctgctggctgctggtcttgcggagggaggaggagggcgctggttgctggtcttgcggtcgccagtcggccggcggtggcgcaggcgcgcagcggtctgctgtgggcttgtccgcctgtgggaggagggaggagggggagccgaggtcagtggagggcagcggcatacctgtggggcggtcggccggcggtctgctgatgtctgctgactgctgtggcggcggaggagaggagggcggccaactaaggagtgctccgcgctggagaggaagcctccacgagtacgcgctggctggacctaaaccctaaaggcccaggaaaggcccacagatgggtaaaacgtccccagaacgcgtaaaacaccctaaaacgtgtttaggatgcttaaacgacgtttaaacgtccaaaatggacgttctacgccagttttctaaaacgttcggacgttccagcttctaatcatgttttctcgcttaaacgacgcttaaacgtcatttaagcgacgttttaataacaatgcgtctgaccctgcctcctccccgatggacccacacttcgagaagatcgacagatcaatattcgaaaaagtacacatagtttggattcggccagcaaaaagttagcagtatgttcacttcttttattaatatagtttcctttttgaacttatatcatatattgacatgaaatttaaattttatgtagtactactatttacaagcttgcttaattttatggtagggtctttttagcccccggtgaattctcgtcctgcgtccgccgctgctcggcatatgcagcagcgctcaataaggcaaaagccaataataaccgatcccactactcccgttccccctgaaaacaccaccaccgagctacattgcctgggcacgcaccttgggggcaacgacggtggcggccctggcgacgaggctggacctcgccgacggtcaccgtcgagagaagcaagtgcgcaccgatggaggccttccccttcgcagcgaaggctgcggcaccgacccccgcgccagagacctgcagcgaaccagcgatgccattcctcgagcagatgaaccctagtggatagcacagaggacagcacagcggaagcgagctgcggaagccgtaggctcgtagcgcagccggacgcggaagcgggcccgcggtgtagtagccctctttatcctggatgggcttcgtaccagcccatgaaactctgggctgaggaggcagtcgtctcactgggactggacctctgcctgttagtttagtttcctcgtcgcgctgggccgccggcttccgccgttccgcggcggagggaagcc

SEQ ID NO: 12031 - DNA, 672 bp, Zea mays
cgtctcttcgcgcgagctcttcctcttctcttcttttttttaatcgtatatacagggagaaagtagtttctgtgggggcgattggttccggtgcccgaaatcaagagcccggagctgggttgcttcggcccgataatatattgtgttgataagaggggatcgcactgctcggtagattggggatttctcgagggaattggttgggggagatgagttcgcgaacagtgtgcaatgtgagtgaatcctgagaggacagggaattagtttggtgttgcgccgcgaaccacaacgacttgtgatagggtggaatagaatcttgttcttctaatggaaagtatggaattgggacctattcgagtattcttatgaggaactattcttctgagaatctcgactcctaatctctaccttccccgtctagaagatctgccagtgctgccccgtctccaagtgggtcttctctttaaggacagcttgctgctcctcttcctatacaactgaagtgaagagagttttaatatctgtattcgatgcaaaacctagctttgttcttattcttgatgccgatttattagaagatctccatgcctgccattactgagtgaagttcagccacagatggccactgtagtcttcatcttgtttcatctcttcttgataaagttgttgtag

SEQ ID NO: 12032 - DNA, 106 bp, Zea mays
ggtgtggtggaagggtgcccttgatggaattggtggccatagttccaatgtttgtggaggactttggtgaagggcgcccttggtgtaatcttattgactgttgtag

SEQ ID NO: 12033 - DNA, 384 bp, Zea mays
tgcagaacctgaaagttgaggaacaagaataacgaccgtttctctggacaaatcgtttgcgcatgaaacagcactgttactccgtatgtgggtgggcggcccaccgatccgtgcacggcgcaccagcaccagtggcacgaccaccaccatccagccaacagacgccaccgcccctctctcgcccgttttttataatcgggttcacgtgacgctacccgcccatcggccacggccagtgccgctacacaccagagcacgcgcgcgcccgcacgtccagcgccacgggagcacgagacacggctaaccacaccgagggcagcctcacttactgccgccgccgtcgtcgccgctcgccgcgcacgctccgacgaggcggacgagcga

SEQ ID NO: 12034 - DNA, 351 bp, Zea mays
ctatcgacaaaatgacaatgagttgtatgactcaatacctcaacaagcaaattggtgaattggatgggtgtatctcttgtttaatattgttcatgacatgatcaaatgaacatgtatgtatgttgatcagcattcctacgcttgttcacttcatcacatcatccttatttcgatttcacattattgaaggttgctgtgccactgaccttagaactgtggtcaaattaagttagctgtacaccaatttactcacatgtatctctttatttctgccttctatgatttctttaccttctacgattttctgattccttttatgctaatatgaagatcatttgtctgtaaataccg

SEQ ID NO: 12035 - DNA, 613 bp, Zea mays
catgccacaacatcctctcagcaagtatgatttggagaacggagaagcaccccggcagctgctccaatggattctgaggtcggagcgaggccatctcaaaaataggagggcgtgacgtgacgatcttgaaatagacgtgccgagagacagagggattcaaaaggaggtgctgcacgattagccgtggaaaggcgaggcattggtggcaatcgcgctgttcgtttccgacggggattagtcagtaactcaaaatcccattgggcactcactagccagtgtttgacgattgacgtgcagtgcagcgttccattgtcatatggtgccaatgtttaccgccaaaaccacgtgacactagtgacatgaaaggaaacaacacaacagacgacagtggcgcttaaagctaaaacaaatgttatctaaggacacagagtcatgacaagttttctaatggtttctctggaattcatcttttataatggcttcaaaaaaatcagctaaaaaccagttcggagtgccccctcacggtgcgacgctacactacactactcgaccaccatctcgttgataaagggggagaattcacctcggtggctcgtcctcatcgctgacgctg

SEQ ID NO: 12036 - DNA, 1149 bp, Zea mays
tctccacgaaaatgatctctatgaataacccgtcgaggcaaacgggaccgtcgttgcaggtggcgtctcgcctctatgtttaggacaagaagattgacaagcataagtgtttcctcctcactatcactcgagtaagagtcttcatcgctatgactgtgagacatactgtgaaatgttggaattgttgatgtagtgaagtttgttttgacatttgtgaagacatggattgcatatatatagggcagaggaatgcggcttcaggtgcaagctagtggcttcgcacgaaagacaaacatggctttcgttggaaggcaattgcggcttgtcccatacgactagtgttttttcgtgaccatgaaatttgatttcttatcacaggatggataaaacgtgatcacaaaaaaatgcacattcaaatgtattgtaaaataatagttgttatatattttttgtggtagtaattgtaaagtaattattttttataaattttatttttgaatacatgcgtaacacgtcggatgggtgaaaaataattaaagaaaatgaaaattgaagttggttaaagttagttatatagaaatggttttttaatgagtagagggatatataggggaaagtatagggggaacggttgcgggacgagtgaatataggggatggaatcttgctgatgtggctgcatagtaacatttagggggaaaaatttagggggcacggttgcggacagccttaaggactgaggagggcaaaatacctttgtccttaacaagctcttattctagtaagagagatagcccaagggcaaaataccatttgccatatcgcgatttatctgcacccgccagccgccgccgccgcctctcttatcgcaacagttcatatttgcgaacgtggcccctgytttgcgttctccaaaccgtaccagcagcgtgccctgatcgccgccgcttggagtcctgatctggtcctcgttcgtcggtatggaacgcccgctccttcccttgaatcagtcgatccccgttctttatcggcttgattagcctctcttcctagtcacctgaacaccgtgcagcgcagggacttaggaaatccaagtaacggatagttcccaccggcagaccgagccgcgcctccattcttgtacgaaacc

SEQ ID NO: 12037 - DNA, 47 bp, Zea mays
tctgtaacgagaatgaaaagaataatggtaatttgaatagagcaatg

SEQ ID NO: 12038 - DNA, 725 bp, Zea mays
agagctgattaattgaagaactgactttttgagagggatacaccaatacagaatcaaggcccaaggggccattattttttttgttcagttgttgacaaaggatacagtgggaaagaaagtgcaaaggaggcactagattgttacgttattatactgttgcttctcaatagaaatctacagatcactatatgatttttgttctcttgtcaatatggtattagtatgaattctaaacgccctcaaaattcattttttgtttcaaaagtgaaacgtctttttttatatgtcgaattgggaaaataaaaaaataaaattccgttgccgggactcgaacccgggtctttcgggtgagagccgaatatcctgaccagctagactacaacggattttatttacggtgtgcatagttatttataacaatagatagagctattcacagtaatggcttagcgacattctcgctgctgcaatggcgacggtctcgttccatcactgtcccccgtcattctcgctgctccaatggcgatggtctcgttccatcccccgtctcttcctcctccgtctcctaatttttggaaaggccatagtttcccaccgcgagacctgtatccccatggatccatgagagaaaggcggaggagatcaggcgacgtacgcgcgtgggggtctcctcctgcacgctctcagctgaaccgccccgtgctcccctgggcgcgccgcgcgca

SEQ ID NO: 12039 - DNA, 634 bp, Zea mays
ggatggagtttacaaatcaaattgcttcgtagttttgtctatggattgtgtgtctttttctagttatgaaaccgtggtcttttatggtgtatttcaggaggtttgtccctccatatgtggctagtcgtgtgattactccatataaaaacttcctgtgtgttggctaatcctttgagtgaggtgaagctggactggtatccattataaataaaactaatttgtgcatatgaaatgaattggttttaggtctcttttttccctaggtacttctcacaaaacccccttcctaaatccatttccttctcgctttacgtttccttcctggtcttgtgctatgggatcacccatgctctcgtgcagatttgtgctggcgtgtacttcattcttgtctagcagtcggaccgttgctctcagtcgccaccgtgttcctgccggccatttcaccgctagtagtcctaatgcacgatgtgtgctccagattccacgatgaccgcgagtccgtggtcgtcgtcgtcaaccacgtcgcacttgttacttaatcacacaagtgggagtggccgccgatcgaactgaaaactaacaacaaaagatccccgcaccgctaggctcaaacccagagctagctagcctagcc

SEQ ID NO: 12040 - DNA, 878 bp, Zea mays
tgacgaaaatcatccaaaatcaacatgaacacataatcaatcgagtcgtcgcgatggaaagaatcagacacttgttagatcctaaacaacatgaatccttcgtctttctccacaagtaatcccaagaaaaaaagattgtgagataaaaaaaagataaaccaaagtcacttagcatgcatgggacgtgggagtctcggagagaccggccgagggagagctattcctaccgataggatttgccaacgaagcaaagcaaccatcggccccgcccccggacccaatcggccagtcgcacgcggaactggaagcatcaaagcatcagccgccggggcgccaacgccaacacgtgccggcgcggccgagttccagcggcacccgtcacggggcccccagcccaccaattcccggtgccatcacggcggacgtgtgcttgcgcggggagagcgagcgatcgatcgatctaacgatagccacaacaggccgttcgttcgtccgcctctcgatcgatcggccacctccgcccggggcgggggccgggggtgggggggcctccatcagctggacggagcggacgtcacgcacgcaagcggacaagcatcctcgtgcttataagcagaccttcccctcccgtccccaaaaattccattccctccgtttctcctggctaaactacctctcgctccctccggctccgatccagggtgcgagctgagcttgggctagtttagtctccccaagctcgtggcgcagcagcagactcgttggtggaggtggattagtagccaaggctttgcagctaggtagggttttgtagctagttcctcgcaggctcagctctctcatactagctagcgtcggtcagtcgggcgagcaggcca

SEQ ID NO: 12041 - DNA, 121 bp, Zea mays
tgttttcatcagacctcgatcctttgcctcatttgtgtgtcgaggtttcagtttgttgcatgtgctcgatgtatgttttggacatcttaagtgtggctcttttgtctgtctcgcgccagca

SEQ ID NO: 12042 - DNA, 913 bp, Zea mays
agttctatctgagcgacagtctaaacgcagctttgtatagtcatttttatctccccaaccggcattagtaagcaggcccccaacgcattcaaattcgatgtaattgtctacttcattttggttcagatttgaacgatgtcagtttcaatccacatgcaacagaatccgcagaagaattcatccaattcacacataaagcagcaacagaagttaaaccataaacatccaattaacgagttgcattttagatcttttagagaggacaacctgggctgcagacgagacaaatcggcatcaacaaccttttcgcgcacaagtaatgtttgggtaggccctgaaccgctcgctattgcagttggggttgggtggcacccgatggatgtcccatccgaacttgtctccaactctgcattttcggttcagagcagtactgcattttgccattgtcgcctgcacgagagactcgttactgttccggccggaaccggacctccctcctgctgctgccaactgccamccagacctggcatggcctggtggcgtcatctaatttctcctatcaaagaatcacctcccattactccgccctgtgcggcgacctcgtgccctcgaattccacgggcacacggtgcaggcacaccaccgccatcaaaatacggcctctttgcggcacggatctgcaccgacgggcgcaattgaattcgagcctgatcgaggtggttggatcgcgcagggaaaccttgaatggccggcatcagtagcaccggctcgtcacctctgaagaagagctgtcgcggtctgagatgtcgctggctctgtatatatacaaggtctggggcgaggtctcaccatcgccagacacactatagaccacagccagtcagccacatcactagctatctgtgcagaggca

SEQ ID NO: 12043 - DNA, 578 bp, Zea mays
ggtaggcattgtagtttgcgaacaacaaatgctctctgaaaaaactagagaatctgaatctggaagcctaaaggatgttgcaatgagccttggtggtgagccatactgtcagtctaatttgagcacaataatctctatttgatatttcttttgtttcaaattataagttgtttttgtacctagcttttactttgctataagtcactttaatagcgaatatatctgctgatgctcgaacttgttcttatgtagcacttttttggaggtttttcttccatctggtggtcaattaacccctaagatgattcatgtcttggattgtcaggtctaggttctggtggtagatttaagaggctgtattatctaaaagaaacgtttgatcttatcattcaaaatcgtagtgaagaacacaacatatctgatttctgatctacaccatttcttgctattttgtcccgtgcaggaaagtgatccgcttcaagcagtagctgaagctccatagcaggaaggtgatgcagcaagaaggaactcccatggttggtcgatatggacgagctaaacctatgtagccagctgcc

SEQ ID NO: 12044 - DNA, 424 bp, Zea mays
tattaagattttaaaaaactcttatacttgttaaaaattaaaatatctattaaaaatatattttggagttgctgagatctgggacactcgagaaacggatccctaatcgctgaaccaaaactacaaaacgaagtgacgatactgccctcgacctctcgaggtatcgagtctcgaccaacccatacgcacctaccctccgccaccgttcccccctccccatctcgcccgccgttctcgtccttgtagatctcctcgcacctcgcccattcgcttcaccaaggtgagcttgcgattctgcactctaaagtctgatctcgtcccgccggatctcctccccaccccatgcgttcagatctggttcctttcgatttgactcggttttcccttcctgtgcggggtgacatagggtttaagaccggcggcg

SEQ ID NO: 12045 - DNA, 301 bp, Zea mays
ggtacgtccttcatgaccttcgtccggagatcgttaaatcctaagggaaataatgcttcgaaggacattaacatttaatactttgtgttgccttgttcttaattcatagcatttgagaacaagtccccaacattggcgcccacctccggtgaactcacttccactgttgagctgatggcttctttcaacaatcaagctgaagtagcttcggctatgaagctggtgctcccgataacaggcggttcatgttcagaaccggccaacaagaagcataagaaggaggctcagagaagggtgcagc

SEQ ID NO: 12046 - DNA, 379 bp, Zea mays
tgttttggttttcattttcccgtagtaaatrtactcattagaaggagcgagatggtctaactaaaaacagttatttgagtaggaattttcttatgttcttcaacaagacaataatctgatcttatactcgttattctttttcggtgaacatttaatgtatttcttttgttaatgaattggttgttggtacataactaaagtgccatgtttatattttagatttcacgttgttgcctatcttaagccgatttggtgactagaggtaggttggagattgatttctgctttcctgctggttcatacaacctattcttctgactccatttgggtcgatcgcataagctgatgggccacaaaggatgttgttttgagaatatcc

SEQ ID NO: 12047 - DNA, 1222 bp, Zea mays
ttactttttacattacgcctagaatgtaatcggatggacgaatattacttgttttgtgtttattttcatatttttttctcttcggatacggatattatcgagttgtgccgaacaagattttgaatgtatatcgacatcttaaatatataactttgaatatacggatacgtatatagatcggatattgaatacccagctagactcagattaaattggatcttagttattttagggggtgtttgaatgcactaaaactaatagttagccactaaaattagttgagacatccaaacacccctagctaatagttcagctattagttatttttggaaaattagttaatagttaggtagttatctgttagctagctaattcaactaattataagttctagtgcatttaaataccccttagacggatcgaattagaacaccgatggataatatccataacattttacacctataaatatgtcctatatgtatatagatgtcaaaaacaggttgggcatgttggatgacccgtggcacgatacagttttaagcagtgccaaacatggcatggcggcgagctagacatgatacggtccggttttatttttgtatttttttttcgtaataatatctgtattatgcttgttcgaacctcacttgcttatgtggatgtgatagtatcaactcgctggcgttccgtgcatcgtaacatctatcacatcccacagatcatgtcgcttatcttttctgatactatagcagtagcacacagatgccggtcgaacccagaagcatcacgccatcaccccctccccttttcccaatcaaaaccacgtccgtcccaatggtaacccagcaccaatctcgtgttcgtgtgagacagagcatgcaaacaaacagcatgcatgcgcgaaggaaagcgtgcagcgcgcgggacgtgaaccgcgcgcgaaccctgccgcccgtccggtctcagctcacgcccagcgtccttcccaggccgcgatccggccatcctgacgcgcgtttcgtctgggccccaaaaccacgtccgccgcggcggcggcgcgcccacgggctcccgtgcccgccgatagtttgccggaccctgccgcctcctataaatgcagagccctccgccagcgtctcccgcatctcatcttcttcctccatccgcactactgagagcgacaaagctagctctctccagggatcggattcggatcacc

SEQ ID NO: 12048 - DNA, 1436 bp, Zea mays
ttggttcgcagcggttatcagtgatttgaaagcctccatctatgcccacttcgcctacctagctctgatcctctcaattcaacacacaggccgactacagtatcaagcatgcttgttgttttgcttcaaaccaacacagaagcatggaagctgaaaactcattgacaacgaatgtatgaggcacttagggagtcaggcatcttctgcagtggggtgtctgcgccgacggggctataggctaccgtcggcacacatcaagatcgtgaagcattccatgggggagatcgtggacaacaacaacaagatgatctcaagtgaggtacccttggtgttctccaaggcatcgtcgagtttatgtcgtcatagcagacaacactggtttaaacatgctgtctagactgtgcacgacaccgacctcttcaacttactcatccatgtcgtcatagcggacaacgcgtgacaagctaagtgaggtgagaaaaacttcgatgttgatagtgtgcaaattgtcgtgaagtttgcaaagtaccagcggttccatgcgtatttgtcaccaatctctcaaggattctagcggcttgtgtggacagccgtggatgagcctgtcgacaatgcaattgttcggtgagatccaattgaggcatgttttcctatgtaatcctctatttttttgaacctcattgaggattgatcatcaaacgattgtccaaaaaaatcattcatgtgccatgcaacatgttacaaatagtagtttggatttccattttgaccttgtagatgtagcgacgtgtaataggtaagctctcatggactgctataattggatgccaagtggcacaacttgtctattcttcaaatgatttattgttttgcaaatcctttgaaggaatcatactcctacacgagtaataggttgtccacttcatgcaattttcccattcattgtcgattgagttgctcgatctgtcatgttacatgcccatgtgacaatttaagcgcaactattacttccattgatgtwgcgtgtctgtttcaagctagcaaagtgtacattcaatatagtggaattttccctttcatcaaagtccaaaaagccatgaccgcaagtatttgatctaggtgtgtcgtttctctataagaagcttcgtcattgattgatgtcacaattggggctgtctacacacaacgattgtctcgctatcaaatggctggatgtggtggtggcattaggtccacgaggtgggctattgaggcttcaacacatttgtgcttgtccctggctttatggaaggatcctagtcacacatgatcttttccatctttgtaatgattttggctaagattggtgtcatcgaagttaagaaagatctcttaagtattgttggggtgaagtgtcaaccatggtaggactctgaaccaagacatcaacatgtcca

SEQ ID NO: 12049 - DNA, 111 bp, Zea mays
cggcgtctgtttaatgtccgttgcgtttggtcgaaggcatgtccgaaccgtaatttctgatccgctacgtgccaggaacggcgcgggatttgctcacgacaggttgtctct

SEQ ID NO: 12050 - DNA, 194 bp, Zea mays
ggtactcctctcctctcccctgctctgctcccctccaccgtcactgtcatggaggccgcgcgcctgcaggagtaggaccctccgcgacctccctcaagtatattcgtagcgagtgagtccgtgtccgaattctggtctctgacgcggcggcaaccccacgcgcgtgcgcaggcatcgactccatcgcggtggac

SEQ ID NO: 12051 - DNA, 1042 bp, Zea mays
caccgacaactctacgttacaaaatagtggttttggtaactatataggtgattttggtacacagtctataacgtgacgaactattcgaacatggacagtgaattatccgagtttatccatcatattgtgcacgaactattcgaacctggacaataaactatccgggtttatccatcagattgtacatcggtgctgccaaattaagcgctcaacaccaaccatgacaatctattatgccgatgtctacagtaacgccgcatgaatgacaatatttatcacaccgtggttagcgattttgactcaaacaagcagcaatttcgttcttcccgattttgcaaaatggacattccccaattcacattccgctgcagttggtatgtgaccaagcgccaaccgttcattttttcctaggaacacacagatgcaaaccgggaaaccgccaatcgaatcgaaaggtggaaacggcgcagcagtagagtacttcgcaccagggccccaccataggttccttgtgccctgcagcctgcaggctgcacaacgcccctcactcctccggtaccagcgctagtcactgacagttgtcccccactggacgtcttctctctcgttcccacctgtcattcactatccaagtcagataccaccgaaaaatcgatgcctcttgccgtctagcgcacacagagccgcggcgtcgacccgcccatgtcccctcgatagcaccccctgttctttcccatctctccaactctccttgcccggctgccccacacctctgctcttccctctcgcctcccgccgttacagcttgcagctccagccccaacccccgtccctctctccctgagccgtcgccttcgccttcgctgcgaaatctagggtttacgccgcgcatcgggtaccgcgcacgcaccgaccgaccacccggcggtcggcgccgctacacgcgggctcgctctcaggtggttgagcgtggccggagaaggggaggggcgacactgctcgtgggtgggtcagccagtgtgccccacgaggaacggcaatc

SEQ ID NO: 12052 - DNA, 1500 bp, Zea mays
gacctaaagattgaaaggaccaatttgatgtcctcgatggttctgactaggtgcttagttgtagggactaaagtttagctcgtgtcacattggatgtttgaatgtctattacagatattaaatatagcctaagtataaaactaattacataggacaaaacaaaaatttaaagcctaattaaccaacgattagcaaatgtttactgtagcatcatatggacgaaacacgaaccaattagacttaataagtttatcttgtcatttagttctcatctgtgtaattagttttatatttagactatatttaatagttatgattgtatctaaatattcgatgtgacatggactaaattttagcccagagaaccaaacgcccttagtttttgtcaccgacctatcatgtcccttctctatctataggctattcccatcgttgtctctattgtcgttcataatggttgaaaatgttgacatctaaggccttttttttaaatatctaaagataatatttaactactaaaatcagttatagaaattccaaacaccctagctaataacctagttaattgttaactaccacacaactattatgccatgtttgtttaccctctaaattatataatctagcttaaatatgttgatatctaaacaaacaacacaaattattaagtagattatgtaatctagatacctaggttataataattcttaagcagattaatagtgcttatataatacataagctcgattatataatcctggaataaaacaaacatggcctcaattaattcattagctagtttccttagctaataatttattagatgactaactattagctctagagattctaaacagagtctaaaagaatattaacttagacaatttaatttctctcaaaactaagttatctatttttcttctagttaaaaatatacaataaataaaatgcctgatatgtaactatgattttcagtttacaaaaatgactcgtgagttagtggagatattcttacccctttctattactcgaggaataactgatattttatcattctaaacgtttttttattttttaataagtttataacagatatgtcaatttaatttatatagtgaaaatgttattagactatgcacagcaactttcctattttactccttatttcaaaattacactcggtctaccgtgtgaaaacgtgtcttctccgtcctgcgaactggcctctgccatccccgttgccaaaacaactcttccttcgttcagtgtcgaactatcgatgcggccgacccgcgcgggcgtcgcgtgggggatgggcgttatacgagctgtacaggacaacgagccgcgtggcggcgccggcagtgctattgtggcggcgactgcaagggcctggagcacccgacgcggtggccggagcggctaggacggccgtccgcggcgcggcctcggccgggctctccgctcgtgtggtttcatgccgtatcccttggcgaggga

SEQ ID NO: 12053 - DNA, 488 bp, Zea mays
ttgtaaagctagcaagagacacctaagtgtgtgtgatcccttgcggtgtattagtgacccaagtgataaaagaaaagcactcgaccgggtctgtgtgtccgatggagaaaaggaaaggattggaatagacccggcctttgtggcctcctcaacggggactaggttctttggaaccgaacctcggtaaacaaatcactgtgttcatttgtgttgatcttcactcgatttgtttcccctctcccctctctcttttaaaagttccttgctcatatttatttgagtttgctcccaaggttatccgcattgattgagcaactcatagcaaggagaactatcttctgcactccgaattatttctaacactaaccgtgggcacagtgcatgttcaaagtttataattttcaggtttcgcctattcacccccctctaggcgattttcaattggtattagagcatgatgcttcattagagtctaacaactcgaagtg

SEQ ID NO: 12054 - DNA, 1500 bp, Zea mays
tctttatgtttcaacaagtgtgtttgacttagagataggaaattgagtttgatttgcaaaaacaaaccaagtggtggcaaagaatgatccatatatgccaaatttgaatcaaaacaattttgagttctcatttgtattgatgttgcacttcctttagttgctttttattgtgttggcataaatcacccaaaagggggagattgaaagggaaatgtgcccttgggccatttctaagtattttggtgattgagtaccaacacaagtggacttatgttaatctatgcaaagtgatggacaaagtgcaaatcaagtaaaaaggtatgtttctaagacttagtacattgtttttgagactaatgtattgtgtctaagtgctggaacagaagaaatcaagttggaaaagagatggctttgttcagccaaagacagctcggtctgggtgcaccggactgtccggtggtgcaccggacagtgtccggtgcgccaggacggagtctgtcaactggctgctctcgggaagcaattaacggcgtacgactataaatcaccggactgtccggtggtgcaccggactatccggtgagccaacagtcagccgggccaacggtcggccgcggaatccgcgcgcgacgcgtggcagagccaacggtcagaagggggcaccagactgttcggtgtgcactggacagtgtccggtgcgccaacggctaggaatctgcaacggtcggcttcgccaaataaggaaagagatccgcaccggacagtgtccggtggtgcaccggactgtccggtgcgccaggcgacagaaggcaagaattgccttcttgaaatgctctcaacggctcctagctgccttggggctataaaagggacccctaggcgcatggaggagaacaccaagcattccttgagcattgttgatcactcacacttcattcttgcgcacttgttcgacattcttagtgatttgagctccgttctagtgagaaactcgagatattgtcttgagctcaagtcttgatcttgtctgtgcgtatttgctgtggatttgagtgtgttgcttccctcccttactcttgtgcttcatattgattcttattgtaagggtgagaggctccaagttgtggagattcctcgcaaacgggaaaagagcaaagtaaagaagaacaccgtggtattcaagttgatctttggatcacttgagaggagttgagtgcaactctcgtccgttgggacgccacaacgtggagtaggcaaggtttgtacttggccgaaccacgggataaatcctcgtgtctcttgtgcttgtccttattgtgtctattgtgcttcacaagagttctcctctctactcacttgatttcatcatactaactcttaatcaagtttgtggtgttaagttttaagttttacaggatcacctattcacccccccctctaggtgctctcaattggtatcagagccgttctcttcaagaaagggactaatcgcccaaagag

SEQ ID NO: 12055 - DNA, 1107 bp, Zea mays
tagaaattattctctgtttaaataaaataggttcacttactgactgcacactctaatttttaggattgaatatgaactattgtagatgtatgttttatttatttaacaaaatgaataaaaagagaaccttagagatttgaacttgtttaaacttgtgaaattaatgataagaattacataagttcatccctgtcctaaattttaggtcaccataaaataaattgatctatgttatgtttatgtaagtaacacttagagaaataataatcaatttccaaaatgaagttaggctatgttgtagtgtatgttatacattgaatccattatcccttatgtaatattatgtctttttaagatgtgttccaatgtttgtacatgtttggtgtgatgttcatttgtattttccaaatgtattgaatgcatgctcgctttatttagacaacgagcagtccgaggttcctgagtgtgttgttggagacctccctgagcagcaacctggtgaaggcaagtgtcctatgacctattatgtcctacatactttatgattcaccgtgccgcattactttatgaaacctaaggattgactagtctgtattcacttatccttgtttacctttttgggttatcatggttagcatgttgttattgccttaacttaatcaatgaacatgatgtgaacatttatggtacgatactgttatcctgaatttgtggatgattttgtgttaccttaggggactcaggcctttttcctgagtacctccccgtaaggacctgctcatggagtgaccacccgggataacagtacaaccattagggtggaatgggacgccctaagctgattaattagatgaacctaggggtgtagttggctttgccggtgttaggggccttcggcttccgaaggtcctcaaaaacatgatttaacaatgtttctggagtacaatgtgtgaacaggtatcttcggacctgagttaaaaccacaacgtgaagaagcacagaaggggtacgaaggatggcgcggagccgaagctgtgtgtagaagagcttcggcatgatagcggaaagggaaaccgacttaaagatgaaaaggctatttagacctcg

SEQ ID NO: 12056 - DNA, 1500 bp, Zea mays
ggggagaccgtccacgtcaggcgcccctggccctagccgcgcgccatcgtgtgtctcgtagacgaaacgtggaatgcatctggctaatagtacgagggctagatactatttggatctgggcccaccttcacagtcgccggcgacgatgattaattgccgcgccgcgcaggtcgggcagcagagcacatgcgctgggcctccggtgccgtatttttaagcgagccgttcggcgctcctggcacaggcgaacagtaagcaatgcctaatgctgactcataagcagattccggcagctgagcagccgccacgtcggtcgacgacgggcggaggcgccgccgggggggggggggggtttcttaagtcccggctcccgatcgatcagatgattcagatcagattctcacggctcggtcgggtgcggggtgcagacaaagaagcagggaggcagctggcggtgcagcgaggtcgattggccctgccttgtccctcccttgtccgtgcgtgcgcgcgtgcgcgcgcgagccccgcttggacggcttggggtttcgacggttcggttcggtgccgacgcccgacggggcttcacggaaggcgacgcttgcttttggactctccgggtaggttggggtagttgggcggtgccacagttggcgacgactactttgcagcgtccctccgatccatcgacctgcagcgcaggctcgtctgcgcgtaaggtctcgctgtccaagggctcacgttaacgccaaggacaacctgaagagcgcgtattccattcggcttgctgttcgtttcctggcctccatggacgctacgctagttgctaggctaatgtaagctgtcatgcctcagccggtgattgaaagaacagagtactgggataagaaatatcaaatgttctcccgcgtagcgttgatgaatactgagcagataccattcattacacgcatgcaccagctgggagtgcatattcgttgcctaataccactgtctacttctagttagcagcaattacagagaaccaaagcacgactgggcctactgctcagtcacaagttgcattgtaacaaaagcaccgcatgccactgacaaactgcacaggcccaagttacaaacacggatacgcttcgcatcgctttcaaagaaaaaaaaaagtgagctccaatctcgtgaagcagatatccatcgttcaggccttaatttttttttcaacctaaaacccgcatacgtataaaaactcatgggcctaatccaaaacggcccagctgaaacgaggaccgtaataggcagccgctggtgtgcgtgatgtgatccgggcctgaaagcagtcgcagagctgtcgtgttcctttgctctccccgtccatgcttttgcaaaattgctccagtcaagggctagtccagtgccccctgaacccgcatccggagctcagaaacccccgccaccggagcccggacggagacgatgccggagacccatccgccgccgccgaggccggtg

SEQ ID NO: 12057 - DNA, 1500 bp, Zea mays
ccaactaccccaacctacccggagagtccaaaagcaagcgtcgccttccgtgaagccccgtcgggcgtcggcaccgaaccgaaccgtcgaaaccccaagccgtccaagcggggctcgcgcgcgcacgcgcgcacgcacggacaagggagggacaaggcagggccaatcgacctcgctgcaccgccagctgcctccctgcttctttgtctgcaccccgcacccgaccgagccgtgagaatctgatctgaatcatctgatcgatcgggagccgggacttaagaaacccccccccccccccggcggcgcctccgcccgtcgtcgaccgacgtggcggctgctcagctgccggaatctgcttatgagtcagcattaggcattgcttactgttcgcctgtgccaggagcgccgaacggctcgcttaaaaatacggcaccggaggcccagcgcatgtgctctgctgcccgacctgcgcggcgcggcaattaatcatcgtcgccggcgactgtgaaggtgggcccagatccaaatagtatctagccctcgtactattagccagatgcattccacgtttcgtctacgagacacacgatggcgcgcggctagggccaggggcgcctgacgtggacggtctccccttgccttgattacagcatgcccacatgccgctgttctacgcagtacctacgaacgcacgatcatttcggtcgtccacagcactggcgccccggccatggtccatggagatggagatggatcatgcgataagcccacgtttggaacagatggaacgtagtaagtgggtaaataaaagcagacaacatgccattatttcaggcctaccaaacagtaaattaacagggcaatttggaatgaacagtgctccaactgctgctgctgctgctgctagacgaaagatggatgatggctgcagcagcagtgcccaaccgaacagtgagccgtaagcagccaactgccagggggcgggcgggcgagcgattggttccgccggccccgccattcatgcaggcaaacccgtgttttgccacctccccatgtgctgccgctcccaaccgccgcgctaccgtgtctctgtgtgccactgtgcccgcgcgcaaaaagtctcaaagagaaaaccaccagcctctaggcgcttttcagcgctctcgccgcgtcagcaacgggtgccgtccggctccgtaacagacacgtcgcccctctaatccgcttttaaagtttaaaccaatgaggagggggaacagggtcttgttctcgcgggtgttaaacaaacacaggttaatcgccaatcatttccgcacggtggacgtctcgcccctgtcgcgtcgcgactcgcgactacctccctcccgttttgtcctcgtcgcccgcttcttctcccccctctttaaaatcccaggccctgctgccagtcccggcacaccggcagcgaccagccagtgatcgaccgaggcagatactgactaggagcagagagcagcggag

SEQ ID NO: 12058 - DNA, 606 bp, Zea mays
acttacaaattgcagttttaggcacaacattttcaagtggttcacctccaagatcaggggtccagaaaatgcaattataagttgatggacctcgatggtacaacctgacaagtttaagggccaccatgaattttactcatatatttaatatgaaatagaccatgcagaaatggtacaaataagcttgtctcaaaactagctttctatacagtttcttttggttttaaaaaatatagtatagtagaaattggtggcaaaatatgtgtctggacaggatgtgctcctaaatgacaattagtaggggactggaggggctacattcttggcaagactcttgaagtttcataagttactttaggcactacccaatgctcatccatgatcacatgctcatgaaaccatctgaaaacaacaccgcatgaagtagaatctgtataacgtgaaacatggttcagtgcgtgtattcataggcctatttgaagatcttcagttgttggaacatatatttagtgccatatatcccaatttggttgctgattttttttttcaattttttctttgtaaatattgcagtatgtaaacaaagaattcttacggaaccgtagc

SEQ ID NO: 12059 - DNA, 427 bp, Zea mays
ctccggtaagtgagatcgcatatctcgtcgcatgcggcgaagaatttttaggtccggtagcttgttctctgctttattcgtggtgaagtttgggcggttcgaagttgatgaattgcttgtacgattcgactgggggtttgtcgtgcttattaggcacgattcgtcgttggttaggtggctgtagcatccctgcttctgttttgcactttctatgcgtatttttgcactctatatgtgttaaggttgacttaaatctgattattcgctcggttagatttggtatcctcatagtgtgtaggtctatctgtcttagaaatactaagtcaaatgttccgcattagcttgcaacccaaagtcttccgcagatagtaatgatatacggaatatcacatttggcagttgatattgattatttaggcgaagggaa

SEQ ID NO: 12060 - DNA, 89 bp, Zea mays; identical to SEQ ID NO: 1440

SEQ ID NO: 12061 - DNA, 1500 bp, Zea mays
  unsure (1)..(1500): unsure at all n locations
agtgcgcgctcgcgtgctggggcgcgcggtggcccgcacgtcggcggccggtcgccttccgctgcaactgcaccggaacgggacggggggccgtacgggtacaggaggcacgtcgtccttacctgcgacgccaccgccgtgcaccgggtccagccacacaccgacgaacggcgatcaggggaccacaggcgcaggggcagccccgtcattccaacgccgatttgagcgcggcccccaccccgcgcgctcctcgatgcgcgcgtccgcttcccggacaccaccctcctgcttctaccccacggagacgtacgccctgcggacccctcataccgtgtcccttgtcccggcgacgtgggccccccgcgcggttcaatcatcaatcacgcgccacgcccgcccccacgcaacctcccgccggtgttcgtgcaccgcccgttgcgcggccaccgtctccctccctccctctctcctcctccgtcatccggctccgctccgagtccgaccgctggtatataggccgtctgctttcggcagccacagtgccacttgcttgcgactggcgagccgatcccttctcgccgcctgcattgcgagctacagctacgactgctgccgctgttccacgtctctgtctccgctttaaggctgtcacctttccccatcccntacgcccccctttcctcctgctcccgcccctcaatcaatcaggacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgcccccccctccggcgatcgatgcgaggcgccgcgggaggcggctcgggctcgggcaggctgtgaggagcctgtccgctcgctgcgtcgtgcgcctgccttcctctcacggtcggcctcgccgcgcgtttgctttcccgcccacgcaggtcagacctccgcgctctaggatctacctaccttgccttcccgcttgcttttgcaatttgcacacataggctcttctctcgtcccgtctgtgctgcgtggatctgtgccgcttttggtgtctgtctgcgcgtgcccactgatgcttccggtttcatcgcttcaggtgcctgccatttccaccaatagttttcctagattttttttttagtcttgtttgttttggccaactccagttcttactttaccactccatttcgccttccctccgttctcggaaatccgattttacacacgcacaattttgttgtgcgcgtagcgagtctcgctccccccggcccagcatttgtacctttgccctccacggctgccgtagcaaaattcggcgctgccgtagctcactgcatccctccatttcctttgcctcccagggatcttcgcgagcggggagttgaagcgcgagatttgcgcggctacgattctgcgttgccgagggagcaagggaacca

SEQ ID NO: 12062 - DNA, 84 bp, Zea mays
ccggggatttgtatagacgacctccaggcggcgggccgcggaggagctagggttctctgttctcactctccctgcgtcgccggg

SEQ ID NO: 12063 - DNA, 769 bp, Zea mays
catccgccagcagaggcggagctccccatgcagcacggtggggcagctgccccacctaccgccggagtagaacccctagtaacccttctgtcttcctcccttctggccgagcgaaggagcggacgagcggcggcgttcgacggcggacgcggctggaagactagagtatgtatatacgagaaacgatcgagaagaaaaaataagcccaatagcccagccggcccaagtgggtaatgccccaaatcccaatccaggacccagcggcggtacctagcagtctgcatccgccgtcgctgcccatccgtcgttgcgctcaggtaccgtccgcacggcgcatgcctgcgcgagcgcagccggcagccgcgcccaaggtcctagcggcggcggctggcggcgcgccgctcgccgcagccccagccccagccgccgccgtgctgtccgttgggattggcggcggctagcgtcgtagccgacggacaaaggggaaagaatcgaacatgtgctgctgggccagatggcagtgggccggaggggagtgtttggttctttgaactcttctttcttcttctcttaacaaagcgagacagtttttatttaactctgtctgaccggagcagggcaaaccgccaaccgggaacacagtacaatggtgggggcctgaccacccagtcacccacccacggacccacccgactcttccccagtgattctcttctacgcttactaggctatacttgacttcgtgtgtttccattccacagaggaaggg

SEQ ID NO: 12064 - DNA, 1500 bp, Zea mays
cgggatcgcagaaatacggatgaaaaaacttaaaccattttcgttccagttcccgcaatacaccatccagtttccgtcatgttcccggttttcatgcaaatacgaaaacggttcagataaacccggaatatggtacagaaagaatcaagatttttctcgttctttttcatctctagttatatgccatttggtcgtttaataacacgaaaaagattgaatataattttttggacagtctgcccctcgtgttcttctcgacgtccttgaagacgaggccacacgatggaagggcgagaagaggatattctccgacacgaacctggtcgtggctgtaccgatatttgccagcaagaactcgaccatggccagaggcacgacctggtgcgtgtctcgggagaggaagggaagtgagcttgtcgccggccataggcgcaaccatcatacccggttgcacaccattatctccgacacacggggttgtgtggtctctctttcatttttaattttagataagaaagagaattatatatacactaattataaaactaattgtatagatcatagctaattcaaaaataaatttattaaatctaattaattcataattagcctatgtttactacagtaaaaacgtctgtcacatggattagtactgctcagtgctcacggcctgctagaatctgcaacggtgtagcttgtcttccatttatagggccggacgaaatgatcgtagctggtcggctcgcttgattagtgattagctcgacttgactcgtttgaattttttcacgagctgaactgacatcctagctcgattcagctagctcgatttattaacgagtcagctcgcaagctaaacgagctatcacattttagcaaaatgaaattatatgtatatcatttatataacaattgatgaaaatattatatgtatgtgtgatgtctatggcttatgagttaaactaatgattgataaactgtgtctatgtgttaaattggtctatgcgaatataactatgggttaaactgatgaatatatgtgtgaattataaattgataagtgatgagttgtgttgatttgatgttatattgatatagtctgtgaaactataattataattactattttctattgttaaattagtttaaaattaattaaaaattgttattatatatatatatatatatatatattgttttttttctactctcgctcgagctaaacgagtaactcaaactcgacaaccaatcgtatccagcactatccatttctacatgaactacaacacatcagagcagagcatggcagcaggggcgtagccacaggccgggaacacgacaaagccgacacgcttcgcgcttctcttctcctcagtttggtgggttctgctcaccagtctcgctcgcagtatacaaagtctccatagtccatcctactgcattcggagaccacggacttgggaagttggaaaaccacactctcacccacagctaggaacc

SEQ ID NO: 12065 - DNA, 332 bp, Zea mays
cgtgtgcacgccaaactctcccgtcctcttcccctcctcgacaccaagctagcgacgctacgcagcagcagctatcttatcccccccgctggcactctggcagctattacccttccccacactgctgcgccgcgcagtcttctgcttctccccaccctcgcctcagcttccctgccgttccctccgatcaccagctgcttgtgctgctgagtgctgaggcaagaaccaccgcgtttcattgttcgagtccttgctcagtcccatacatgttcctcttctttgtgcttgctgctatagattttgaactattattgttcacgtgcagggtagcg

SEQ ID NO: 12066 - DNA, 1500 bp, Zea mays
tgggaaaaagggggagtttttgaaatcttgaatcaatttctcttataatgactctctttatgttttaacaagtgtgtttgacttagagatagaaattcaagtttgatttgcaaaaacaaacccaggtggtggcaaagaatgatccatatatgccaaatttgatccaaagtaaatttcagttctaatttgaattgattttgcacttgttctacttgctttatattgtgttggcataaatcaccaaaaaaggggagattgaaagggaaatgtgcccttgggacatttctaagtattttggtgatttagtgtccaatacaagtgtctaagtgtaaaatggtggacaaagtacaaactaaggataaaggtatgtttctcagacttagtacattgttttatggactaatgtattgtgtctaagtgctggaaacaggaaaaatcgaattggaaatgagatggctttgttcagccaaagtctgctcagtctgggagcaccggactgtccggtggtgcaccggacagtgtccggtgcgccaggctggctcgagcgaactggccgctctcgggaattcaccggcgacgtacggctataactcaccggactgtccggtgagccaacggtcggccgggccaacggtcggccacgcgatctgcgcgggacacgtggctaagccaacggctagaagggggcaccggacatgtccggtgcgccaatggctctcaggctgccaacggtcgactgcgtcatttctggaaagaaatcgggtgtgcaccggactgtccggtgcgccagtcgacaaaaggcaagatcagccttcctagattgctctcaacggctcctagctgccttggggctataaaagggacccctaggcgcatggaggagtacaccaagcattcctacaacattcctaagcaccaagacatcgatttcgcgcattcgtttcattgtgatagcatatagagctctagtggagttgtgaactcattgagttgtgttgcgagctcttgttgcgacttgtgtgcgtgttgacactctgattcttgtgtcttgtgtgtgttgctaatccctcccttgctccgtgttctttgtgaatttcaagtgtaagggcgagaggctccaagttgtggagattcctcgcaaacgggattgagaaaaagcaagcaaaacaccgtggtattcaagtgggtctttggaccgcttgagaggggttgattgcaaccctcgtccattgggacgccacaacgtggagtaggcaagcgttggtcttggccgaaccacgggataaccatggtgccatctctgtgattgatccttgttggttattgtgttttgttgaggattcctctttagccacttggcaattattgtgctaacgattaaccaagttttgtggcttaagttttcaagtttcacaggatcacctattcaccccccctctaggtgctctcaattggtatcggagccgttctcttcaagaaaaggactaaccgcccgaagag

SEQ ID NO: 12067 - DNA, 220 bp, Zea mays
gtttttttgctaaaaattgaggatgataccgttgttttagagttttttaggcactcttatatttacttcaaaatttcctcacgttttttattgattgatacgccgatacagttgtctgtctcgccacaaatagcaaagtgaggtagtgtataatatggtttggtgcggccgcaagcgaagacatgcaccccaacaatcttagccggcacccccgccaaga

SEQ ID NO: 12068 - DNA, 462 bp, Zea mays
tatccgtttttagtgtagtatctaattatgttaaacttaaataaatacgatttagcgttatgtattatatattatatatccgttagaaccaaacagctcaatcttttgtttttcacaccgaccatatagaataaccctccgactgaccactgaccaccagttctgctcttgcgtgacatgatgatgaggggtttagtcggttgtgggcggcaaattatatgcataaaaacctctaaccagaagctaaaacccttaccccttgctaaattagtattttgtaatcaagcggccgctaagcaaataaaccatatcaaggcgtcctcccgcggcccatatatatacacacacacacatcggctttcccatctccggcctcacaccgcaaccgcaagcaagcgaagcgcagagcctgcctgaccagagctagctgagctacagccaacagcagctggtctgactgac

SEQ ID NO: 12069 - DNA, 285 bp, Zea mays
tgtgagtgagatccaccatttcctataaktgtctactttttgttctttatmtaactattcttttaatagatgcatgaggaagatagacaaatacagaggcatagttggcttttagatctaaagatgatcattttaaagagaatcaatgaagaggctgatgaagtcaaagcatacattgtgaaagcattgcttgcttagcaggacaaggagtgcatatttgttgtttgccaggaagggtaaggcctagcactaataacactctatagttttttaatctgtatctta

SEQ ID NO: 12070 - DNA, 1500 bp, Zea mays
aacagacccttaacaacttcctagattctagctgctatcctaacaaatgtttatcttatctaatccaactctatccactgaatgtcgatggtggccgccggcgcacgccgctggtagtgtcggccccacatgacaatatcatgtacaaaagatccactattcttaattgatcgaggcatcaagcctgcagatcatccctgtggcttacatcttcatagataggcatttcatttgcatagaagatgcacttataaatacacgaaaaattgacacctacattgcaatcttaagatgccataattgaggatccactttccagacaccaaagtgagcaaatcccaatataatatgtgcatgctacaattactcagaagtattgaagcatgcaaacatctcattcaggtgaaggttgggaacaaggcactgacaaacaatcataacaatacaagtaatccctcgtaaatttataaagtacgaacacacaactattagttttacatcaacgaaatgactattgtatactcaaacacatgtcacttacagccactgttggtgaccagatactttgtggcattcatcgttaagggtagtccctagtgatgtaaatgtcgatatccattcaaagagaaaatatgaaaacaaaggaacaagtaatatccgtccgtatccgattcgattacattcctaatagtccccaccatgtctaactctttagtatgggcttgagtaacaactgcctaatgaaactagactaaggttctacatagcggataatgggccatagtggactagcttcagtaacagcacaagaagttgtattcctatattgaaatagtatccatatctttgagttgcatgtgtgtatttataagccttcctatagaattcagatgtaataagcaattaagcaaagcatagaattaaagaataataatatgtagagaaaatatttgcaacactgcattagccacaaactcagctggcgtatgctatataacccacaaccatcactataggtgattccgtctttaaacgctatactgctcgcaccttgtaacactccaccactagtccaccaccactaccaatttaaaatgcaggccgtagaaccatatgaactcaacaaccatttcaactgaattcagaaggcaagcaacctgcaacacctaaaactccagtagtccaatcgatccaatagaagacatgaatcctactatcaaaaaccaccatagcacacctgttcctgttaagataggctttaaaccctgctatgtaaccggaggttgttgagattataaagcaaccttcggagataagggtgctcagtagatgaggtttatctgtaatctgatctgtacttattcgagtgatgtgttcgctctatataaacatgtaaccaacgccgaggaaaaggtatgtggttcaagccaaatacttccgcttcctctgatcactttcatggtaatcagagccaaacactacacaagatcaaacgccatc

SEQ ID NO: 12071 - DNA, 739 bp, Zea mays
ggttgcctcctctttctgctgtataatttatgtacttagttgcccttgtagaaataaggtcttttgcattgcatgaaatagagagccacctatctgtctgatatggcattatttttttgactgggtgttgctgtgtatcatttgaagtcaagcatggtttccccttgttttttctacttaactgtctatgttttattaacaaagtgttgcattgaatactgcagaatatgctgttgtacctttctacttgtcagctgtttacatgtatttatatagtaaatctagaatcttgaaataaacatgaatcaggaaatgctagcattcgttgtttgcatgaaattaactttgattgtgaacagttaccacaaggcctgaaaaaatttgtgacaagaatatgaccctgtagactactaaaacttctctcctgtcactgtaatgattccactgttactgcactaaggagctgtatttagtattgttggttctgttaacatgtgcatagtttcctgctttctgtgtttctgtaaggtccaactgaggaaaaaagctgtagtgaaatttaagagcagttagttattggtgctctgatagtagatctagctgtttaatactgaactttgtcaattagttctattttcatgtgtggttgcttcagtaggggtatggaaaattcttaattttctatacataaagaattttcaaatgatttttgagaagtttttccgtcaattttaggtgc

SEQ ID NO: 12072 - DNA, 273 bp, Zea mays
tggcgccctccgcggcccaccgcggcggcgccgtctgcacgcacgcattctgcggcgcgtgcctgtccggtcacgtccgcgccaagctagagtgcggcggcggcggctccgtggtgcggtgccccgacgcgttctgcgctgccacgctcgacccggagctctgccgcggcgcgctcctctccgaagtcttagagcgctggtgcgccatgctatgcgagtccgtgctcctaggagcgcggccgcacctactgcccgttcccggactgctctgag

SEQ ID NO: 12073 - DNA, 136 bp, Zea mays
tcagtacccctgcgtcactcgctccgcgctgccgcgatctcctctgacgtcgtagtcgcccgggggatgacacagggggaaggggtggtgtgtgaggggtgaacaggagctcggtgacttttgtgagggccgtcag

SEQ ID NO: 12074 - DNA, 132 bp, Zea mays
ctgagttactccgttgtacgtgccaatcatcacctatatatataatacgcattattaagccactgtttgagtcgtgagcaatcatgtttatggacccttaatttagacgtcgatctccagtgacgtgaactc

SEQ ID NO: 12075 - DNA, 517 bp, Zea mays
gatcctttagattaaatattcagtgattttttagcaaagatcttatgaaaagaatgaacttctgtcttattgttgcctactatttgctcatgctccagcctccagctaatttcagtgcccgccacagaagatgaagcatgggctattcaagctctagagtcaaggtggaagagattttgacatatccgtagaaatgaagttctactaatttcgcttacatacataggcatatgactggtgcttgttttctacttgataatactgcttgcttttttttacacagctggcgttaatgacacaggttgtatggtccttgatgaacaaacaatacctggggtcatagaaagcggagatcaatgtaaagccaattactgaaaatgaaaagccaattactgaaagcggagatgaaatctcttatgaaggagcaaaggcaaaaagtccaatatctttattatcgggactacgaaggagatcaatgtaagttcagtttggtccattttatctattttcctttctt

SEQ ID NO: 12076 - DNA, 599 bp, Zea mays
tataattggctgtacggcgccgcccccgtagtcgtaaccagcgaccaaaggatagagacatgaaccagcgaccaaaggatacagacatagggcacggcttttgaatgcatttttttagttttttatgagttatttcttaaagctgttgtagaaacactttttaatcacttctaattacttttatagatatgaaaaatctacatattttgacaaataaatttgaaaactgttcgaaatgctctgacaaccagttctaatcagtgtaaacagatcgatgcgacctttgcttgttgaagaggcttgtatggactttagtgagatggtagaatttttctcgtacgaattattcccttgcccagctgtatacgttgtaaacaactaaacatgcatgcttgtcgctgcatgtcgtaaaattaaatattaaaatcgataaaacattcaggatcgatccgggccgcctgcttccacgttcggtaggtagagaggcacagctgtaccattttgttttcttattgattgcatctccgtcgacctaccagctgctagataggcatgtactattctgactgaccgccccgttcgtctctcaatctctcctc

SEQ ID NO: 12077 - DNA, 135 bp, Zea mays
tattaaaagcaccacaagtaggagtaccattccgattatacattgcagttgaagacaaggttattggggctgttctgacacaagaaactgaggggaaggagcatgtggtgacatatctaagccgaaggttggtgg

SEQ ID NO: 12078 - DNA, 536 bp, Zea mays
tctgtttcaacatgtgatcagcaacattattgaattcaactataagattatcaattgttcacaaatatgaaaacagcttaaatttacaccatacagcccagatcataaaacatacatactagccatatgtaatccgacactgcgtgtccatgaccaccacagcatcattgtccttgagcaaaatgatcacatcaaagcatccctcggcagcataacacggccatttcaaccttcgcctacatttattatcagttaccccgaacacaaaatctcgccttcgacgacccaaatctactacggtactaccgacaaaactgcaccgcacaactaatagagagagagagagctatgcagggaataatcaccacacgctcagaagcacacgacggtacgaaacatcacgacatttgccaaattctggttggtagcctagctttggtcacttacctaattttggtcaggcttctttgctccacaaccaaacaggcccatagggacgcgcacggcgcacggctagttccgtcgcggccaggtag

SEQ ID NO: 12079 - DNA, 246 bp, Zea mays
cacgagcactattacttttatttaaaattataataaaccacgattgtatttatagttagatcataatctaatggatcaggtaattcgcttgcgccgttggatacagatacttctttcgtaacagtcgttctctttttctacaactctactgaagacatgggttagggtttccgcgtcggctagtttggacgcatggctgctgcaggagagtagagaccacagcgcgcgaggcgaggagaataagct

SEQ ID NO: 12080 - DNA, 64 bp, Zea mays
cccagtcttgctccttgcactcctccctccatctccagcattgtgttctgattcacctgctcca

SEQ ID NO: 12081 - DNA, 1500 bp, Zea mays
tcgacatcggacttgctatagggacccgtatacggggcagacaagttggtatgctttgtcgggtgtacaactatgcacgatcctaaaggctacgtgagggaggctacgtcagtaggactgccaaagacaacagagcacacccttaccaataagaaacaagtcccctctgtaaggtcctacccttgaactataaaagggtaggaccacctccttcgttccacacacacacacacaccagttgtaacatagtcctgaaagcaatactacgatcaacactacactggactaggccactagggcgagagcctgaacccgtataaactccatgttcgaatccttgggttcaccattcggagtgagtctgctctagcatccctatcgatcacaaattctattgtcccctagtatccagaaccacgacaattggcccgctaggtaggggaatgttagcatgccaagtgacacctttgactctgatggcttagtcatcagcgttcaccaactgtgagacctttacgcttcggacccatatcatgtttggatcccttaacttccttagagcatctccaacaacgtgacctataaaaatgccctataatttgaaaataagtatattttatagaatttagggcaccaacaaaacacctcgctccaacagtaaagccccaaatctagattatagggcagcccactacggtgtagtatatttgagtcacttgagagggtgccctatagttttttgacaaaattttatgaaataggacactgttggagtagtttttcctgtgtagagccccatatttcaatttgaggcactagtttgaggcattgttggagatgctcttaggactaatttggtgatcggggatccctaggggaagaaatcctcttacttttcaaaattgaattggaagggattcctcccccatggatccccttgggatacctaatcaccaaatcagctcttagtaagaatattatccttgcacataacattgtttatcgcgacctcggcgggtagattcgccgccgcccacagcccacccggtcgctggggcctccccgtcgtcgccggtcgctcgacattccccgtgccggtccgcgcttccgatccccagcgcttccccgagtcgctgcgtgctcgcgtttccccgagccaagggtcgaaggtcgattcagcgccgtcctcaccggagcttgtccacgcccccttgtcccttcgcgcccgctccttcgccggagaccaccacgctgtccttgagcccgtcttctcgggaaacggcgcttcacgccctgcaagcgggacgaccccgtcccgcatctacggtgaatattcgcctgtgggacgagcccatcccacttctcctcacatccaaccaaacgccagcgagaagaggaccgtcccgtcccgttacggttcgtctctccacccctagttccccaaaccggggcatcgattcatcgaaccctgcccggagacgcgagcaatcatagacaggc

SEQ ID NO: 12082 - DNA, 788 bp, Zea mays
gtttgatgcggcgtcccctgagaagtcacggacaaacttggcagcgatagatctttcatcttcgtacgcagtggggggcgattggtcaaatcgcagacagtgtctcggacgtcgccgtgcttggtccggtcatcctcatactgttgcagcttctcatggttaaacgcgtatatatttgtcaaaagccgcgcgtttgcaccccccgtttcacacctgtttttttttttttttttttgctcccccaccccgatgacattggaaagagtcaaaggccctcaattttgaattgctggtggtgtctattatttcaatcgtgtttcggtcactacttgctatggttgaagttgaactagccctttttctagtgcaataattgccaatataatagttagccgttgcgcagcctgttatgtttacaatttcgcctccattgttgctctattttaggattcttgggaagccctgtacctgactactggatccactaccaagctcttcaagttccaggatccattcctctttgtcgggcaagagctcttggcctctgtggattatcagcctgattcacaactctctgcaagaattcgagcgcagatgggccaagaaagcgcggctgacgcgattcctggtttgatggtttctgttggtgtttcgggctaacagactctcttttttttgtttacttcctcaaagttccacttcaacatgtggtttctatggatccgggcttcccgagttggaatctgatcactcgcgtcagtgcttcttagcttccttcatttgccgtc

SEQ ID NO: 12083 - DNA, 426 bp, Zea mays
cctaaatccaaagatggtgtgctaagaaaaaggcggtagaaaaggggcgcagaaacagcagagcaggggagcgcgaaaccgagacagggacagcgagacgctgacaggcaggataagcgtcgcgaaacgcgaccggcctcgtgccctacccctcgtcccgtcccttccatcacgtattcacgggcacgagctcgagccctcgtaccctccttcccttcctcgcgcgcggtcctccgatcgaactgccggacccgagcggaggagagcagggccctcccgagggccctcccgcgcggcgaccccgtggcgttcctgcgaggctgctgctcgttcgggtcggcggggcggaagcggcccaaggcctcgcccttgccctccccaccgcgcctgtccgccgctgcagcggcagcggacgacggggccaag

SEQ ID NO: 12084 - DNA, 164 bp, Zea mays
tctatcacaagcaggatgtgaatgcaaagctgtgcctcacgagcagccctgatattttgtgctcaaccaaggtgatcagtcgtgctgggcgcaacccagtatttgagtaaagcctacgccttgatgtgcaaactgtggatgcttctttcaagtgcgaaatatgg

SEQ ID NO: 12085 - DNA, 162 bp, Zea mays
tgtgagagagtttggtcaatctgataaagccctgttgattcatcagtggtaatatatcagtgtactattacactttatagctttatgtaattttataagaaccgtgatgtcacatcacattccattgtctggcaggtggcaagtgcaacagcaacattcgtg

SEQ ID NO: 12086 - DNA, 1500 bp, Zea mays
ggtactctcaatctaggagataattgcatttttaggactccaaacatagcgcttaacattattgccatcccaaacatttatttcttagaaacaggaccataaacatctactaattgattaacctgccattaaccatatttgcttcgtttttctaattcatctccatgtatttgtggtctacgagacacttttgcccctcacgcaataaacaagcaaagtataaccggcaactctacagcatgcatacattaatcttcgtcatcgttcggatgctccttgacattctgaatttgatacattaatctttgtcatcgtttggatgctccttgacattctgaatatgagattaaccattaacattctcccagattgaatcagttcttggcaactcgtgtccttccggtctcaatgacttccggtctcaggaacggattgaagcgagctgcaccaggaaagtagtgaaagtgattaactcgcccctaaagccaaacaataaatacgagcgatgtaggttgttcatttatttatgttcttgagcctaattgaagcagactaccatttcagtttttaacatgttctgaatattatttttgggcaaaaagcaatcatcatcaaatacaaccctccaactctaaaattttccattttcacatgtagaactcatactgggatctatggatttacctattcttgttttgctcaaagagatggccgtacacttggaacttcttgtgccgtacacttggaactaatactgggatctatggatttacctatccttcttgaygtctagaatttttttgcatgattttcacgacacccaaggaggaggtaccctacgtccaattgaacaattaaaagatcctgttagcacatatcttgattaatggaatagattggatgtgttcgatcagcatcagaacttgtaacagtatctgccaagcagagattcgcaggcccttttgctctctgaaagtaggtcatcagccgcagggaattagcagactacactgatatttcttggcacggggtctaggcatgccttgcccagtgctggagaggctgtggccaatccggctgcgatgggcgattcttcaatcagatcgctcctcctgtcgtccatggcggcgcgacaacaatagacgaagagtagacgaatcgtaaacaagaatagttttggtcaagaatcatgcacaagggtaattgtgtctcctcaggcgcaaactacgtgcaaacgaattataaaaggaatattatacgctcaatggcagtataatcaattagaagatctttgtaatcctatttatatgaaataaatgtttggaatggcattactgcaaagcgctatgtttagagtcctaaaaatgtaattgtctcctcaatctagtagttttggttttgttaagttcccttttcaacatctgaatcttatttgtacttactatggttttggttgccaaaaggttttgtgctaacactgataccttacctattgcagct

SEQ ID NO: 12087 - DNA, 154 bp, Zea mays
agcctaccaggcaataatggtatgattcctgcatacatgtgaaaaattgattgggtgaactgtcaagtgtgtgtaatccttttcttttcattcggtctgggagcaactacctgcactttatgatttgttgagcacatatgtaagtgaatgagct

SEQ ID NO: 12088 - DNA, 582 bp, Zea mays
gacaatcacaatctgacaatcacaacactgtgcgtgcaaacaaatttgccttggaatctttgagattaaacaaatcgctaatcaccaacgcactgaagcgcttgcttttaatattactattatattgttatttgtatataataaatcttgtcagattatatccgattcctctgtccactatacggcatgtctgacctgttgagtcgatcgaaactctccctccctggaccgccttcagatccagcagtcaaacttccccgtccccggcgaccgtggggcccaccacccgaacttcttcgcagaacaccagacagaccccacgccgggcccgttccagtggaccattgggctcaagaacagcccgacgtgggatgggagtgtcctcaaacccatccgggatccggccatcccgcacgcctcgtcctcactcctcagtcctcacccccgacacaggtctcgctggtagcttgccctcgtctgcgccacgcctcctctagcccacctcctgctcctcccccactcgcacagtgctcaatgccgcacaaaccctagtgcccccactccctgtctcgcgtggcagcc

SEQ ID NO: 12089 - DNA, 1500 bp, Zea mays
gttccctagacaagcaaaagatacccagcaataatacgccaattgactagcccgttcccagtacattactcagagagaaatttgtctcctccagtggaccccttttttgtatgaaagaagaaaacaaaaattcaagggcgctcaagttccctccttgcagtgatcagtgcctccattgacgctagcgacagtcaatcggacaaatcattaattatactcgcgtacctgcatcgcgattatgggaagcttgattcttgacagacatccagcgcccgcgacgtgcttctattggtgttggaccggagcagtaaccatttctgattagaattgctagctgccggccggcgataaacaaaggaaagatgctctctgtcctggaatacgaacatcactgacatcgccttttttttccctccccccacgaccctaactgtgatgattgaccaagccttttccttcctcaccagaaagaagtgacccagtgagtgagttaccgtacctgaaaagcaagaagaagaagaagaagaaaaaaaaggacaacactttggtctgacgcataaaatcttgcaggtgacaaagaaaatgagatgcacatgcacggaacgaacagcagctaagacaaggagtcttaattagcaacagatgaaaggtggacaagaggcctcttcccaactgtgtgctctgccgtgcatggagcacccgtgacacagaagtagctgcggaaaagagagagagagagggagagagagagagagaaaaccggctgctaaatgtcacagtcacttaccatggcagcaagagcatcaatccgtgtcctaataacatgaactctggtctttcaaaaaaaaataaataacatggactctgaatatgggcacgcgcgccccactttcactgggcttgtgcccgaagaaacacaccgcgtctgcatgggaaccctggtgccgaggaaaacggaggtgggctgaatgaaacagactcttgctcaaaggtcacgacaatcaaatatcacgtaggaggtggctacggggctaccccaccgattttggcaccagacatagattcttaggagatgatgaggcagacgcccacacacacagccggaagcaggccaagggaagggctaaacctccatcccttggcacaagccccacaagccacaaccaccacctccacctccaccaccacctttaaaagaagggtgctaaagggctgtcctgcgaagaaaaggagaggagtgcccctagcctttccttgctttccactgaaatctcctatctgcagccatgcagttgctcaatcctggcctcagatgaagcccaaccattcattggtatataagtcgctacaacctttgcaatttcccactacttcagaacatcgtcgaagaagctctgtgctaccggagaaggtgttcgtcgtcgtgcataattatacattccgcagacctgtaagctctgtgagtttggttggagctcccaggttctgcattgcgttgag

SEQ ID NO: 12090 - DNA, 220 bp, Zea mays
ctcgttccgcgcacaggcccgggaacaaaaggcctgatgtgtcgcacgctagtgggtcagtgaccgcagcagctggaacattgataagaacatggagttccttcctgcccttgtacttgagagtacggcgcttctcaccgcatgaacagagcttggagccacagaggcatggacgccggcagctcgacgctcgatagtcggtgacaaaggcacgaagacc

SEQ ID NO: 12091 - DNA, 1438 bp, Zea mays
aaaccagtctcttctcagcctctccaacataccagtttggttcaatctaacataagcaacacaaataacagaactataaaaaaagcagcaatgtagaactgcttttgtcacacgccaataactaaaacgtgtagttgttgcagtaaacttttctcaccttgggattctacatccgctgggttgccactggagcctcacgtaagctttgtcaggcaggtcgttgaggtggcagttgaaggactcatcgatgtgagggcatgatcccgtaggatacagagggatcatgagtacacctgtgaaaacatcagacatgccacaaaatgattaaaagaaagcattgaacccctacaatgttagttcaaaattgatttgaaatgaagttacaacagaaggcatcaggagtatccactctaattctccaccatcacaacccaaacacaaaactgatctatgcaaccactcgcaggcacaactcaatctgggagccaccacagccaagcattgcacataaggccgaaacatttctgtctcccgcctgctcgagaggccgagatcaacatcccaaccacaatgcaggatccatggataggacgaagcaagatacggttcgtcactcacctgcttcgtaggacgcggtagccgttgcagctcctccgcatcttcgctctccttcggctggagtttcgggacgagagacttcgcggcgatgcgcgcgatgggcgtagacggcgtcgtcgctgctgctcggcgggggagaggatgccctagggtcgacatcgcgagagggccggcgggcgcgaaggggggcatttgcgacgggcatgcgtatccgggaatcacacgactacgcgagtgggactgtctccgtggatgcggacccgagaaatagcgagcggggcaggtgccagacgccggctgggggtgatgacaatcttgagccgaggggaggcgcgacggaagtctcgggagggggacgggcacggttctgcgggctgggttgtctcgacaggacgggagaagaccaggtcgtgagcgcggtcggaggcggaggggcgacgacggcaatctggcgagggagacgtgggcgggaaacgggggcgggagcacggagccgaggtgtggtactagataagcttgattacaggtcctgaatacgccgggcctgatccaggcccacttccctgcgaaacctttggattttcagaggactcgaaacttggggagctagctaacgtttttggtaggcctagtagcgcaatgcgggcttcgaattccccgaggcggcccataatgctggctgggtcgtcctgaccaattgatggttctgcttctgctttaccactcaatcttgttgagagtcgccggcgccggcgattcctcctccaccgattcgcccggcgggagtctccgcagggctcaccgggaccgcgggtccacg

SEQ ID NO: 12092 - DNA, 1500 bp, Zea mays
tgtgtttgtttattcacgatttgttttcctacttcctccctaagttctcttgtgttgatttccattctaatcattttgtgttgctcctaagtttattcggcacactcattagaacaacacattgcaagatgaacttttctccctaactctaattgtcttccctcttgctctaaccaactaattaggatcaagttttgtttaaagggattaaatttcatgtttcgtttatttacctccctctaggtgaatatcaatatatcacatgtacgatatgatgtaaagtcaccaacaatatattgagacagaaaattcatcaataattaaaagtttattacacaactggattcatattagaatatgtttatacgagtattgtgtgagaatatgcatgcacaaatgagagaaggcaagttgtggagcctttttatataaactacaaatgcttagatctcttcaagttattagcccatgcaatagcacaggttgtgggactagtgtaaaaataaaaaaaatataaagataatataggacttactaaaattcaaggatgacatcggggtggggcacacgatttttggacccggtaggggtggggttgatttttcctctgcgagtctgcatgtttgaggacctgaactataacggtgtctggagcgggattttttatcccacccacgggtgctccacgggcctaaaaaacaacccacacggagcccaacccacataaaggcctaggtatataagatatttcccgccatccctccacgggtgatatttcaaatccaaattttttgaattcacacaaacaaaaataatgctctagaatgcagtgcacaatataattttatatatttcccatttatttaattaagaaaataatttaaatgtatagtccacataaaaagcactgattcagataaatcttttggagatctttatttaattctcaaactaggagatgttgggcgttacaacgtgggctgcagcggtctctttctgcgccatcacattttcctcttggaccaatgggcaagtgggatatgggccagtatgtatgcaccataattagccaatggcgcgcatcttgttatgaattctatagttttatttttattttggtccctgcaaaagttttgaatattgatactcttctatactctgcaaatttagttaaactttagaaaatttgaatagtaaataaagctgtcgcatcctcttctaggttctgttggaaccacacggactggattggactgtgagggtacagcctcatcagctgcgaaagtgggcaagaagcgcacaacagcacaacacggtaaccgcaaaactggaggcccatataagacgcacggcccgtcacgtcaaccagcagaggcccaccccgacgtcccctaatccccgggacccctccccattcctctcctcttctctccctcgcccctccctccccaaaaccctaacccatcgtcgaccggtccccgctctcgtggcgccggcaag

SEQ ID NO: 12093 - DNA, 1500 bp, Zea mays
gcggaaatgcatacgttgcattagatttatgatcataaaatgacatcacatcgtccaacaaagacctttagggacaccaatacatagcaaaaacaatgtgcaatagtagtagaaagagagacagtaaaaggtcgatgttgatacgagaaaagatagcaaaacagatttgaaaggaataaatataactaaagacttagcctttaataggagcacataaaaacggttatccaatcttgacttgtgacttatgtcaggtttcaaccctagtctatgaatcttgacttgtgacttatgttgagtttcaactctaatctaccctcaatttgtctataactaaaagacataggctatccatgtgtatgaaccttagatttgtggattctgttggactagcctactttaatttacttgtggaactaaaagactttatctttgttgttgcgttgtaatatcattcttctattgctatagtaatggcttttattcaagagaccctttatttcatttctttaaaggcatgtagtttatacaagttaaaaaaaatacaatagctctaggtgatagttccctgtgtaagatttcagaaattgttcagaaaagacacagaatgtataccaagtartgttaggaagacactggacattacttatacaccaagtaatgttagaaagacactggagattacttgggtgagatattgcttctcttgttgtagctattggcttagatctcttaagttccaagctatgcaaatcaagcacatcaacttcctaaatgaatacggaaacatgagttagtgacaagagagaaaattattctatgtgaaaaaattaaaaaagaatgaccatcgcattattggtttcactaaaattgaatctaatttaccaagtatttaacgactctatttctacatgagattttaaaataagctaagcacaacaactcttgaaatccaggaaaaatctctcaagtgtccagtttaatcaatgtactaatagaaaaagtaagtaaaaggtttctaagttggagtaaaattcatatgttgcatcaccagcaacagatgcaacaaatgaccagggcagcaggacatcgatgatcctcttgatctgtcgtgaacgtagcgtgaacactaggcaatctccatagttttttttttgaaacaatccatagaaatattaaagcaaagtaagcgcaaataagccgtacataaccgtttctctcggaacatagtagataattacaggcacggcatagttgtcagaaacaccacagttcacaggtctgcataagacatgatcacaagaaccgagtgtatcgagcagtcacaatccttgtccactcatcgaagcagctcctcgtcaagattgagattatttgattcaacaccataaattagcgctagcaatctccaggaaaagaatgtacgtgttcttcagtgttcttcagtagattgattaccacaggcgagtggcgccgctcgccaatgaccacgccccacgg

SEQ ID NO: 12094 - DNA, 399 bp, Zea mays
tgaaactgagctgcacagtgacctgttgtctaaaccacagggcattttttttgatatgctgcaaaacctgaatttcttgttgcctcttgtaacttcctgatccatccagtaagacatattggtttgaagatactggatcaagggaaagaaaatgacccaccgaattgtgagttggcagcttgtgatggaggcttgattgcaatccagagcagtgatatggtgatggagacgagtccagaccagacatacacaatagtgggcgtccttcctctccttcccatgagccccttggcaaatggatacagatgagcaagcacccagaagctgaagaacactcccccaagcagcttgctccattgcgggattgtgctgtagatcgtccggctgaagccaacagca

SEQ ID NO: 12095 - DNA, 295 bp, Zea mays
aaatctgacccgtttgaatgcgtatgagattttttgctctggatttttataatccaataagatccaaacagggcctaaaagatagaacgattccacacgcacgtgcggcatctgcgggagccaaggacaaaccacagcggcaggaagaatcgcattcgattaggcagctgcggggccgccggccgaaccgcctccgcagtccgcaccacacgtgccacccccgcgcgcctccctctcctcttcactccgccaccattcttctccccctccggcgagagcgtgcgcccaccccgcc

SEQ ID NO: 12096 - DNA, 226 bp, Zea mays
ggtacaacatgataatgatattattgatgatagtgatagtgatagtgatgatgaatttgcttcaccttcctatgatgaactagctgacttgcttaaggaatacactcaaatcattaggaagtcaaaggctaaatgtaataagttgaaagatgaaaatgaatttttaactgccaaatatggcatagttgtaaaagctagtgatgaaatgaaagaataaaacaaaact

SEQ ID NO: 12097 - DNA, 251 bp, Zea mays
ctgtgtgctcacaggcacgtcatcatctagtctagtacacgaatcacgaacgcgtccacctgcgcgcatcgccacgcaggttctctccaccaaaccttaacctccccttccagaaaccctccaagaggcagctcaaaggaatagtgagccgccccgccgctcctcagccatcctctccatctcggtgtcacacactccgcatacgcacctacgagagtcgagtgacagcgagcgagcgagcgagcgaagcc

SEQ ID NO: 12098 - DNA, 1500 bp, Zea mays
tgttcccacttttcgctcctcgtttggttcacaaggaaagaaacgcaggcaggacttgaaatactgtaaaaaaaaatctaccgtccgtatcgtatcctgtcttttagtccaccggtaaaattacgagaatatattctctatggaaaatatattcctatacttaatctaatacaacttttttagtactataatgctagatcttggttttacgcgctgtttttaagtgagtgcttaatttctagggactgtttttagcgcatgtttggtttgtggctaactgtgctacacatggccaaagtttagtcgtccgaattgaagacagaaaaattagacaaaatgtgacaagttagacaccaaaccaaatatgcccttagtccctttattttatttcattttagtatatataaattgtcaaatacggaaactaaaatagagttttagtttctgtattcaacaatttaagtactaaaatgcaataaaatgaatggactaaaaactattctctataaaccaaacacctccttatggcatgtacaaccaactgaggggtttcttgagtggtctctaagggtttagtgcaaaagaaatcaatagacgagctctttgcgaagagtccgtctcttaacgactttctatacatattgtattttaattgtattgatattctagtggctcgaggttatacgatgtattttcttagccatctcttctacttaaaagacagagcaataggctctaggttgtacatgcccttagaccacacaacattcaaaattagggcgtgtttggaaacaaggtatttcaaaatcatggttttgaaatattacggttttaagatgtcataacacaaccataatattttttacatcagtcttagctataagtgtttggaaacaaagtatttcaaaccataatatttagtatacatgtgcaatgctagtcatagaaaaaaactttaggttggtgtgaagtttcaaatactctaaaaaataccgtgaaaatgctcggcccaatgaaaatcctagagtcttaaaaaacattaattgcctatatagaaaaacaggcctagtgacttgtaatgggatgttgtcagaattgaacttacggcctttgaaccaaaagcaagaatcctaccactagacgaaacaacccataagaataattaataagatgcaaacctgatttaatagaatgatttcagtttgacaacatttccatttgcgcgaaatttgctaacaagggtgaaggggcgccaaataatctggagtagaatataaaaggtccggcccattgagaatcctgggagccttcatggcttcatgcgggggtcaagcagaaaaagcccagcccaattaaaaccctagacttcctggcgtgctataaaagcaggtggccgccgcctttgccttgctcaccctgcccttctgtgtacgaagccgacgagcagccgacgctaaagcttggtccggtgagcttcagagaaggggcgggtacgtcaag

SEQ ID NO: 12099 - DNA, 99 bp, Zea mays
tagaaaaagtttgacgtggtcttgtatgttttactagtattcaatagctggtgcagtgtattcatttcctcactgaaacctctccaacccctacagtaa

SEQ ID NO: 12100 - DNA, 300 bp, Zea mays
tagaaaaagtttgacgtggtcttgtatgttttactagtattcaatagctggtgcagtgtattcatttcctcactgaaacctctccaacccctacagtaaatgagcatgacgattgaccaagaactcctcccgtcttcttctctgcccttctataaaacaaaagaacagaagagagcggcaacggcaagaccagctcccgccggccactcgtctagactcgagagcggcacgatgcctccttctctgcaccctccccacctccacttccacaagctcaagcgccgccaccaccccgccgcc

SEQ ID NO: 12101 - DNA, 1044 bp, Zea mays
agttactatatttattaggaagcccaaggctttagatatataaagtctctatatatagaggaaaggacatgtttttcgtgcttcagtgcaaccattagacccaaaaccaattggattttagacagaaattattccaattgatyaaactttatataaatcatgtgaacagtccgactaggaagacatcgttcgtcaagtaccgaacaagcccttaggccgttgcgagtgcaccatcctctctcgcctctaccacgtcagctctcgactccagtctcgtttctgttgctctcgactccagtctcgattctgttgctctaccgcattgatttattttgacaaattataatttgttttgttgcatttaaactatgtattgcgtaataaataaaataaaataaaaataaaattacataataattagaaaaaaagaacatgagatccaactaagtaagaggatttataagtgttttttgcaaaaaaaaaatttggtactccaaacaatcatcaacacctattataagtggcactgaagtagcttgtgtggatcaaattagaggccgtcaaatcattctcgcctcacccctttcgcccgcaccgtatccactcgaatgcatggccccactattgttccaattgcctcgctctagcctgcactagagagatgataggcacgctgtcgttgagcccgtcccaaaaccctatctctcgccccttttgtagctggcacgaccatcaactttggaccatctttagcaaaatatgtatatagatgtgtaaaatattatttgacagcatagattgtattatttataaagtaagatttgagatatgaagtagaatagagtgtgctaccggttcgtggcactctcgcgcgccgtttgccgtttgggctcggttgccccatgccccggtcagtttcacacggctgaagccagccggaacgtgttgaggaggggtgggggatagggttttttcgcaagccagcgaggcagcgaccgttttgtcaccgcaacacccccgccgactccctcgccgccgccagga

SEQ ID NO: 12102 - DNA, 868 bp, Zea mays
gtgtttggcagtcctcgacagttttgggtggacagaatttgcgaaaagccgaaacaaatagggccagagagaacccaggtggagtccacgggatcatatgagagttgatttggtgtaggggcaaattagtctgactaaaggttgaaacactatttaaataattttatgtttaaaaaataaactctaaatgacattttgtctataagctaacatttgggaatgatgtattagcgaagtacattcattcacatgatgacatttaggcgaaagccggtttccataatggcataaatccaaatttctcgtgaatatctcagcgccgagctcgagcccgcagtctgccatcccctttcggtggcaaccaaatccggcttgcctgcagcggctctccatctggtcggagtggatcgggtctccggtggtgtttctcgcctccgtggcggttagtggcgccggacggaccacgtccccgcagcagcggtcagcggcggctggcctagctgcggtggcttgaggcggctctcggacgggtgcctcgagctggcaccagcgggtgggtgccgcaactctcaccgctagctggtgtagaggcggcgagtcccggcgccatggagggtaggccgcaagtgtccgcttagagaggggtcaacaaagggacttgtcaagctacgacactgcggtcttcggttgccctgctcagcttgttgttgccgtacatgatccttcatgatttgtgagagatctatattccccgaatcttcaccggctctgccagatcactggcgatcttcttgccagccgcctccgctaacctgcgcggcacagtagagctcaggaaaagcggtgggactgagggagaaaagaggag

SEQ ID NO: 12103 - DNA, 414 bp, Zea mays
gagaggaaaaggaaaatgatataaatttaaataaggtggcgcaccttttttgacgcggtcatcatgactgagacgaaacggcgcctgcttcgcctgccgaaggtgtcgcttgccctgccaaggagttaatgcgacaggacgggcaatttgcggggcgtttgttgcgcgtgcgcgagtcgtctaaggaacagaaagaccgtttcacctttgagtttgaatcccgcgacgggttcgggcgaagccttcggtggatcttgcccgggcctttatatactcgggagaggggccgatggtggttctttaccctgccatttgcgcttgccttctgctttggtttccgcaacctaagagagcagccaaagaaaaggaaaccacacacctcatcccctctgcctccaccacctctgttcagtg

SEQ ID NO: 12104 - DNA, 118 bp, Zea mays
tataaggttgattagcccatcttaatagcgtgtttatagatgcggctgtagaatcaattatatggtgctactacacccgttgattcaaggatttctctgttgacttttcgtacttggc

SEQ ID NO: 12105 - DNA, 1014 bp, Zea mays
cggtaatgagaaaactccatttacagcgctgtctcactccaaacatctctcgtctctgaactggtagtacgcggtagatttgtggagtgaggtgaaaagaaataatataatacatggtagttgttgatatatgtttgagatatatagtaaacatgactgcgaaggactatagtatagggtagatatttttattgaccacgatagaatatcttttttagagtacaaatttaaagtgatatgagagcggatagtctgacggtgagcactagcattaattcatcattaaacatatcatttaatcagcacaagcatttttagggtatggaagattttgtttgcaaaaaagttaaaagtttgcacatgtcacggtgatagtaataaagtgaaactctataacaatgtcaaacttgaatgtttgttaaaaaagtgaggtaaataattataaaatactatttattgtccaaaaatataaaatagtggaaatagagaactcatatggtttattgacttgatccgtggctaaaaaaataaataaaatgtttaggttaaattctggtggcgtattttgaagcatctcatttcctcagcatcaagttgaacctcaaatctgaaactgatgtggcatctaaaaactccaaagtccaaactcgcacattttcctcagcagcaaggattcggagccagccggtcgacgtccccggaaacgagagagcagggcatcccaattcgtcctcctgcgagagcgaaggccgttactgccgtgccaaaatcgcggatccatctctcaagagaacggccactttaccggcggcgccggccatctctcaacctcctccgagcgaagcgtgcgggccgggcagcgagtacgactccgatcaaatagagagtccgttttccagacgttggaacgtatagatagcatccatctactcgttcaaatagcgagtagatcctggtgccatagcatccagatccatctactggtcatagccatagcatccagatccaaacatc

SEQ ID NO: 12106 - DNA, 1240 bp, Zea mays
tttcaattgtactaatatttttaaatagttttggaatactaacggttttaagatgtcatgacacaactgtagtatttttaacatcactcttaacaatacgtgtttggagacaaaatatttcaaaccataatatttagtatacatatgcaaggctagccatatataaaatatttaggttggagtggagttttaaatactccaaaaatatcatggtatctataaaaccataacattataactagagttttttacgagatagccaaacacctcttatcaataaatatgctaccttcgtttcaaaatatgtttctttctaggtttttttggtccacattcattttaataataataaatacagatatacgtgcaaattacattcacagattaactaataaatacatatttaacataaaacgaattttattttgggacaaaggaaatattatagtatttttcgtaccatggttttaattttaaaactccaaaaatatttcctccacacctgcataaagaaaagagcgcacactgcacacatcgaatcaacccaaccgaatgcccccaatccgtgtaatagacgatggtccgagtacggtgggcgagcagcatggacctttgagtttgagagcgatgtgggcacggtgggagcacgagctctgctaataggagtacaggctccgtcgcctccgccacttgattgaagtgacgaaccgacgattgcccagcagtctcgctgaaccggaaagcgaagtgtggaacacgaaaccgagtgcgacggaagaagaggagccggatccggcaagggaagtggaacatggaaaacaactcaaatgggctcgttttcagtagatgcggcccatgatttggtgaaaaaaaccggcccaatcacgtcacgtccgtcaagccaatcttgatcagcaaggtgggtccatgactaatcttggcctagcttctgtagtgcgcggaaagccgagcccagttcacgggcccactatccttttgcagttttgctcccacagtgccccttgcttgaaagcgaactggaacatgttttggacgacgagcacctcgtggtttccgcttttcccaaattgcccctctgaaatcctcgcaggcctacggtctcgcggtattgcgcttctcgtcttctctaatcctcttctgctccctccactaccagtccaccaccaccactgctaccatcggttccccaaaccctagccaagggacacggtggccagcg

SEQ ID NO: 12107 - DNA, 512 bp, Zea mays
ggtgagagctcagtcgacggtaatgccgccgcagctcctttagtcgccaggcgattggcatgccacggttcctggttcatctcgcagagttagtttgagttcgaggcttgtgtggtgttgctgattgcgcacaagaggtccaggaacatataggcggcggatctggctgcgttctttctgtttcgtcagagaaggggtttcaggtctctgatcttttatccctgtcctattgtcccaatacctgttcattctgttcttgctgtgattctctcacgaaatgagctgcacatggttcattgacacagtcttttttatagttatatcttgtgcgaatcgcaagttttaagcaagttgactatctgggttcatctgtttcagttctgtactttgtctttgacatttattctttctactcttccctgcagcgctgccagctttcacataaacaagttggggaagcagttgaggttttctaattcttcttggaaggattgagatctccagttctgata

SEQ ID NO: 12108 - DNA, 470 bp, Zea mays
gctcgtaccccaggagaatcctgtcgaatccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttctgttataattactaccgagctactatctccacattattattggtaaagaaagaaagggcgcctcctctaatttgatgggcattccgtttccttctcaacttcaacgccaacaacaggtagggcggagcaccattctttttcttttgtacatttgttatcgactctataatcgttcttcaacaaggttgcatagagaaaaggtccatttcatgttgaggaatattgaatcgagaattttataatgacctcattgcagttgatgctact

SEQ ID NO: 12109 - DNA, 1150 bp, Zea mays
tttgaggactcatcaaaccaaatcagccacgcatcaaactaaatcccgcctaaacacagtactccatgcgtgcctgagaaatccacggctacgttcccatgcacacattatctgaatttcggcacaatttcgtgaaccatgcgtgcccgagaaatcctacccctagctagaacagagtagtgcacaatttcaatctcaaaacaaacagaaccttagatagagaatataccctttccaaaggttgagagtaggaattaaaaaaaaatatgataaaagaaaactctagattgaactagaggaactatttaacttttatagatctcgaaaggcgtgcttgttcttgttctcgccgagaggagagatagattagagagagctgtaagccggtgcctgcagcatgtctgcaatgtgccccgcatcgcacgtcccaggggcgtcgggcttgggtgccacctccgacggacgccgacgcttttgcagctactcattgctactacacaggacagtactggggcgtataggaggatagggatgaactgcgtggcgtgatgaactgctcgtgctccagaagaagacgtgcctcgcgtgcccctggaatagccgtgaacagtgacgtttccaagtgcattccatctgcccaactcgcagcaagccgccgccaggtcgtcaagaagctgctggtcgtcggggtcccagaatgctccataattccaattgagggtgccaggtaattagagctgtaaattaactaagatctaagttgcaaaatagtgttttgtaagacgatatgcaagatctaaatacgaccatatgcataatctggtatatacagtttaatatggtgttacgcggtgcttaaggtttgtttcttttcttccatgtgaaatggagtgggtttagtgagattgaagtggccaatagtttattttcatcgccaattcgtatgtattttaagatggtatggattttgtccaaagcctcagcctgtctattatcgacagtgtccctttggccctgtctcgcgtctatatatgacaacccggcggctctaaaactaatcgatgagatttatcttgggatcggctagagaagatcgagtgagaagttgcgcgtgtgaagccatcacaccaattaaagatcgagatcatcc

SEQ ID NO: 12110 - DNA, 362 bp, Zea mays
ctctacctcctccgctcccagcgctccggtctcctcagcctcttcaaccgcaccgcagcccccaccaacggctccgcccccgcccccatctcgctctccgatctccagtccgcgctcgagagccagatcaagatcaaccgcgagattcaagcggcgctcctctcctcgcaccgctcagggtccggcaatgcgaccgaggacggcctggatctcgatctccctttctccggctgcaggaagagggaattgccggccagccggcggaccattgagtggaaccccaagaaagaaccggttcctcctttagtcatctgcattctccgggcaaatgtccaaaccacttgatttgcttggagaagcac

SEQ ID NO: 12111 - DNA, 150 bp, Zea mays
ggtgagtactttcatcactttaatatttcctctgcctctccytagctcctggccgtcttatttagccctggactgagagtttgtcgacttcgtcttcctcgctgctcatcacttcggttttgccacccaccgtcgccatgggagcatttg

SEQ ID NO: 12112 - DNA, 120 bp, Zea mays
ggtaattatcacatttaggtccatttttttatcgttttcatgtcattctaacacaatttattcctgcagtgtgtattggaagaaaatctttccaggagagctgaacactacttttttgaa

SEQ ID NO: 12113 - DNA, 947 bp, Zea mays
tgatttgtgcagcacaaagtatgatatgatcatcatctgatgatgatgattcatccaaaactcgtgatgacaacaatgtattttcagccatcacctgattttgcaaacacatatactatgaatatgtactcacgtaaattaaattcgtaactgttgaatatacatctatttaaattaaatgagtaaatcgtttttgtccctgacggcgcaacaacaatggacggacaacgcatcaggattcaggaatagggcaaggaaagaaccacgggagtagggagggcaacgaacaaacagaaagctttggacccgaaaatggatttgaaatctgatggaactgttggagataaaaggttttttcagtcctaaaccatatctatcaacttctttatttccattttctaacgaccagtttgacaacttcgtttttttaaataatttgttaacctcattttctaaaggaatttttattttctcaagtaaaattagtttatctttctgtcgcgtactggcgtgtgccgcgcacccctgccacgtcggtctgagtccacgcgccacatcacccctccggaacccaacggccaacgccacctcacgaatcacgacgcaaacactcccacgaaccgctcgccctcagcagcagcggcgcaccccactggacaccggccaccgcctgaccgccatcgcggcgtatcgaacattcgaaccgaaatccccacactaatcccatatctagagcaataatcaaatcctttcaaaagcaaccccgtcttttagtagcagctcattaatcgcccgtttcgccatcgcctcaagtacaaaccgaccgccccgtcgttcctcccaatgctccgcacccggacccgccctcgcccacgcgcacgccgcgcgcccgcgacgccgtagcagcgcgcgccgtcgagtggtggggctaggatctgcgtcgagtg

SEQ ID NO: 12114 - DNA, 1500 bp, Zea mays
catgctggaaagggagaagcgaaacgcgcttcgccgaccacggctctgcattggccgggcggccttatctggactggacctatagacacctgggcgcgcgaattgcagcttgcaggcaaggcagccccgtcccgtcccggtgtggctataagcctatacgtacccgtacgtcagagctactgctatatatatagaatccagaccattggtgttgctcacgcttccactacaacagcatcatcgatcgccgagcgtgcgtgctctagctctagcaatagcagcgaggagacggtcgaggatggatcagaacaacagcaacaggcagcagcagcaggcgccgccgccaccacccgcgggtcagatcgatcgatcgatcgtcatctccgaataaatccgtgtggatggacggatcgacggacacatattgctgacatggcttgcttgcaggctacccgacggcaggcgcggagcagcagggaggcagcggcaggaagcagggacgccgggggaagacgacctcgcgcggggagaagggcttcatcgaaggatggtaaactaccaatcacaaacttaatgatccttcagtcgtccgtcggtccacccgtttctctgtcctcttctgctacaaaaaaataacctcaggaattaagaactgctactgtgtggcgtgtttttggtttttcagcatcgcggcgctctgctgctgctggatctgcgagatgtgctgcgactaggcagcccccccttccctccgccgccaggctttgagcctttgacaggaacggagagatctgctccacccatagctgcagttgtggctgcacgtacttgttgagctgttgtgttgtgtccatctcggtactttttgatttgttattagtagtagctgtgatgacgatgcatgggctgctctgtcttctgcagctctagcattacactcactactacgtgtgcgtgttgtaccgttttgtattgagtggtgacttgaaggtggcgctggtgatttgtactaccttctatatatgcatactccttggtacgcaaaataacaaaagtgacgaaagctagcgcagagaaatgcaaatgggcttgggccgtatcggcatactgggccgtgagtttctaataacgcatttgggcttctccgcctggggcctccgcagtccgcacagggacgccgtacatcggccgtgggactcttgcctgactcttggattggattgggcggcacgcggtaactctgtcgtcttgtgttggaagccttttgcccgtcacgactctcggcggccggccgagtcagcacggacggaccaacaaccgaccgaggactacggaacgggtcaaagccaagcctaccacagaagagagtcagagacgcgttgcagcgaatggcacatcgcccaatccgccgtatcttactcgcgatcgcgacctgctaccgtcacatgaatcctacctggactaataaaactgatatacacgtcttgctccgccgcgccc

SEQ ID NO: 12115 - DNA, 1041 bp, Zea mays
cgtcactattcaaacaatttaattaaagagtctaacaaaatatattttatgcctaaatgattatttagcttaagtgttaactcatttaattatatagcaatgcataattgaaaaatatataaacaataatttcggctagccagtatagtaataattttttaagatgtgtctataaaaaaatatagagacgagttttaaaaggtaggtacacatagccgaaactgagcaatccaaaatcgtataaaattaattattcacatattgttgagataaattttcggtactttagtacttcaagatagagaattacttcctcctcgtattttagttaaaaataagctgacaattatctgagaacagaaatagtatattaaaaatgatgcaaactattgaaacgtggataatacgtattgataagaaggaaaccactagtacgatctgaaaactaccgacagaagcagtgtatcggtacggtccaacctttttacttgtatatatgatggccctaattcaaagcgatgccaaaaattgtccatttcatttcatattctcatgaccaagattttcgcacgtgcacgattacaaagcgcacgcacaataccacaagccgtcgacccatttggttgcatcagctcggcggctcgatcgatttgaagccaagtccatcaccgcctaccagacaccgtagcgagcccgcacctaccctctctttctctgccgtagaggacccacattgtcatagacgtaaactcgccaccaaaccctggaggtacgacctctctaattgcagacataatccccaaactacccttccccctccgttccacttccaccatctcctatcgtctcgtctcctatcgccacccctccgtggctccgtcatcgcgcacggctaccaacccctcctccgcccgccaataagtaccgccccgctcgccacctccatctcagaggagagagtcgctcagcactgcacgactcctcccccatctaccactacctgtctacctacccagcccatcgatcacccctcgcaacgca

SEQ ID NO: 12116 - DNA, 1500 bp, Zea mays
tataaaaatacttattaagacaaatcgatgtatgtaaacatcatgttttaaaactaaataataaaatagttatttgtagtcaaagtttaacgagtttgactcaaatcttattcaaaacgacaaataatagaaaaccggaaggaggaagtctaatggtaatggatcctaatctaaatattttttactgtttatttgagctcttaattatttttagtttagaaatgaaataaaatagagcttgataaaaatgtgtttaaattattaaattttatagcgcaaaatttagagttcattaccatctctacatgtgtccacacgaccgggatctaaatctgccctttcaacaagtgcgtcatcggcttgggcaaagaaatgggctccatcttttgtaccactaacaacgaaatccgccaaacctcggatcaagttgttcggttcggattaaagccaactatttaaagtaatgtagctgtaatcgatagaagtaaaaatactgtaaaatcagtagaagctgttatagattaaaggcaaacgaatactaagcacatgccagaagtaaaacacataggatttaaccattttattctctgttttgtcagctttcccttcgtttctttttcttcctattatttaaaacttttacttgcccgttattagcaaaaggtgtctcccctcgctctggctggtaaaggagctctatcatcttaggccatcccgtacgtcgatttagttacctgcacatggctgtatgggttgcacaaatgaatataaaataagtcattttaaagtcatctgcttgtattcacttgtacgcttaaaataaccgtatccggctgatctggctgtctgtgggctgtgaaccaatcaagcggtatctgaactagttttacacaacttgagacataagaaagcttaaaaatcaaggtttgcagccagaaattagtaaaaaaaaaagggatccggaaagcaacataatgtctgagaaatgatagagactaaaaacaaggataaacaagagagagacaaaaaggagacaccatactagttttcctctttgctagagcagaatagcaattcaacagctaaagctaaattctcaaaagcacgcgttaaaataacctaaaatcgacttgaatccaagaataaaaaaaggagtgatttgattcagatgatcgaactggtacacaggaaaattgaaaaaaatgcaagtattgactgcatgttactttagggaagttccacagacaagtcagctaccccatagcaatcacttcaaggacaagtgattcgctcagcaacagctctcaccaaactaaatgcttcacccattcttgcttgcayatttgtaagtttctctagccaaggctcaaacaatgatacaacacctcacttacaaaacatcacctttagtgctaccactatacgagttaggaggcaggagacatatatgaggaaccagtagcaccatactgtaacctcatcttctctgatgagaaagag

SEQ ID NO: 12117 - DNA, 523 bp, Zea mays
tggctggctggtctctcggctccgggctctctcgctcgctagggtttgctcgtcggcgtgggtgggtggggatggggagtaagggaaaggggaatttgttggaggaatcgagagatgggggttcttgggccgggccgggccgggccgggcctgtgttgactcgtgtagttgctggggcatggcattttaagccatgaggcccacgtaaggcccacaaggcagagacggcggagcgcgtctgtcttcgtcctcctccctcccacatcccacgcataccggttcgggcagatacaaatggcggcaaggcatccctcgttccctctctttctccctctgctggaccaccgccaccaaccgcaggctaaaattagcgagagaggtgtgcggtgggaaggcgtgcaggtatggggggaagcagcagggggtggcggcgaggtggcattagagattggaaggagggagggaggaggcgaggtgagagaggacgaagagggcgcatcgtgggttgggtgatcacggcctg

SEQ ID NO: 12118 - DNA, 83 bp, Zea mays
ctgcagccaaaacaaaatcagcatccggatctccacattccccaccaaaaatcatcctccggacgaaatcagcggcggcggag

SEQ ID NO: 12119 - DNA, 487 bp, Zea mays
tatttataataataaataaggttattagatatgttattaattatatttttatagtatatatatttgatgtcataatttttttaacaatttttttataatttcaatctagtctaagatgatttggttttcaaagaatagtgagaacggggggagaattatccaaccatgtgggaacaggagtaaacgtgaaagccacacgacagtatgcgttaggttgtttcctagcgcttgactaattaacttccgtggtccttaaccacagatgttacgtcggtaccttaaaaaaaatctcgagaatatgtggtgaatatttaatatggaaaggaaaggggcggctttcttgttaaaaaaaatctcgagaatatattcactagctagagggactagtagtaggtagtagtagaggagaacagccactcagccagccccctttacttgcacacaatagacaacctcgaacagaaaagaagcagttttgccgtccgag

SEQ ID NO: 12120 - DNA, 148 bp, Zea mays
ccctttatatccacacgcttgctcttctcactccctcctcagctagcctgcttgcttcgagcctagctgtctccgtccgtctagctccagctctccctcgaggcccggaacgcgaggacgacgaagagcagagccccaggcagccaca

SEQ ID NO: 12121 - DNA, 1162 bp, Zea mays
cagcgctgatcttgatgcctaatcaactattgagagcagacagccatgagcctgagacaaatggaaagtacaaattattgcatggattattaatcatcacatgccatagataaaaattcctgttgttatagccataacatcgtaaggttagttgataattacgcacatacgagaagtaaaaaaatagaagtttgacgttaatagaaatggggatacttctcttttcagaaaaagagcttaagaaggtcatcagaaagggaatcaacaacacgtggtgggcaacaaaaacaacttcaatgtcctaagaaatctagaaattctttctctgagtttttcttttctgttctagagtcaatagctgactgtttctgttaactgaaaatgtatttgtcacacaatgcttatataaaccacttgattaagttatattatgttaggacattttggcagtccactatttatatctggtttgatgttgttataaagtgatctctgctatctaatctattttggtggtcgtaaagttttgcttgcttgaaatttgatcacattagttgaattttgtctataatcacatcagatgagaaattatacagccttcttgcttaaatgtacagaccactgtttaattttttgaactttatttcccaccgcgagaaactgatttatttccaccgagagaaactggtttatttccatcttttcttctttttagaaccggaggctatcctctagcttgataatctcacctgcaagattcgtttttttggctaatccagtccggcgacctaggtctctcggcttgcccgcagcccgccggtcagtaatggcgtaggatgatccggttgtttctgctcagtggatgcacgagcacctagtgatgcctgatgttaaggtaaaaaaatcatctagtttgcgtgttcatattcacttcagagacacttcaataatgcttccttcatcgaagaagaaagttcagagatatacttctatcccctgcgttagtggtatgtgagaatataacagtttggttgtctatcaatttgatcttcytttttatgcgttgtgttcttattactcccagaaataattagagggttagggacatatgtgctttgtggcagttatcagcttgttttaggttttggatgcttcctggtac

SEQ ID NO: 12122 - DNA, 330 bp, Zea mays
ggtaagacgttgaactcggagtaaagttttgctagcacactgcatacgtggcatcacaaggaaaacgctgtactagggtagggacacgctcgccggcaggttcgggctgccttcctccacaatccagcggctgccgcacggctcggcctcggtcctacagctacaagaaccatctctctctctctctctcctctcactcactcactccccccattcctacctttcttctcctccacctcgtcaggcaccctcaaaccctcgccgcaagaaagaagaggtcaatcaaatcgaaccaaaacctcccgaccccacaaggccaagctcatttcc

SEQ ID NO: 12123 - DNA, 1260 bp, Zea mays
tttctaagtattttggtgattaagtgtccaacacaagtgcctaagtgttaaattgtgccaaggactcaagaagtgcaaatcaaggttaaaggtatgtttctagacttagtacattgatttgaagactaatgtattgtgtctaagtgctagaaacaggagaaacaattttggagaagttggctgtgtacagccaaaaggctgctcggtctgggtgcaccggacagtgtccggtgcgccaggctggcttctgtcaactggctgctctcgggacttcgacggcggtgtacggctataaatcaccggactgttcggtggtgcaccggactgtccggtgagccaacagtcggcccgaccaacggtcggccgcgtaatccgcgcgcgacgcgtggcagagccaacggtcagaagggggcaccggactgtccggtgtgcaccggacagtgtccggtgcaccaacggctctgaaccgccaacgctcggcttcgccaaagaaggaaagaaatccgcaccggacagtgtccggtggtgcaccggactgtccggtgcgccaggcgacagaaggcaagaattgccttcctggaatgctctcaacggctcctagctgccttggggctataaaagggacccctaggcgcatggaggagcaacaccaagcatcctttgagcattgttgatcactcacacttcattcttgcgcacttgttcgacattcttagtgatttgagctccgttctagtgagaacctcgcgatattcttttgagctcaagtctgggtcttgtgtgtgcgtatttgctgtgattttgtgtctcgtgatctttgctcatccctcccttactctgtgcttctttgtgaacatcaaagtgtaagggcgagaggctccaagttgtggagattcctcacgagcgggatatagtaaacaaagcaaaacaccatggtattcaagtgggctttggaccgcttgagaggggttgattgcaaccctcgtccgttgggacgccacaacgtggagtaggcaagttttgtacttggccgaaccacgggataaaccactgtgtctatctgtgttgatcctcttgtggttattgtgttttgcaagaactcctctcttgccacttggccttattgtgctaacgcttaatcaagtttttgtggctttaagtttaagttttcacagaatcacctattcaccccccccctctaggtgctctcaattggtatcggagccgttctcttcacgaagggactaatcgcccgaagag

SEQ ID NO: 12124 - DNA, 1171 bp, Zea mays
gagattatagaagtgcaagttgattctaaaaaaatgcaggagtttttttggaaaaatattaacgcaggacgaccgttgaagctggtactttaatatagtatagaaaatataaagaaatcaatattttaaatatatatactaataatttaaaaactaaaattataatcgtgttcgaataaatatctcatttaaacaagatttatctatacctatataatatatagaaaccataacaaattaacaatatacgagtaactagtataaataatataggtaggtagaatacatacgtaggtacataaaagttattataaacaaaaaaaagataaaccggacggagaaaactctctgttctctgaccgcaaactgggcttttaattgggttgctgctatttgcatatgagtttaggcactagcagagtgaagtgctcaccaaccgttggatgagaattagatgacatccaggtgaggtaaagtcgaccgtaactttaccagtccgcgccggcggcaacctaccctgctttggctccgggcctccggctgggtggctagcgtgcctctttttgttgtcgtaaaccctctctctctctctcgcgcagtctcgctccctctgtctctctcttagcgacgactgggcggccgtcgctgctggcctgctgccctacgccaggtgcccaagtcttcttcgggctcgtcgtcgtcggcgacgaccaccaccaggtacggtcaccccttggcctcccttcctgatatgtgaaaccgagcacctaaaccccatcttaccatttgtattcgtcggacctgatctaattactagcttatatgcatgtattatgcctactaacttcgattattttgcaaggtgtacacctatgtccttaactgggtccacccctggttccacgtcgaatctgtgttgaattgtaaagataattttgtgaatcatttgaagtttcggctgcttgtgtcgtacttgaatgcctggtttaggattatttgctggcatctttgcgccaccagtgctttacccatcttactactcttatgttgcatgctctgattctaatcatccgatgtaacttattttagcctgaatagttcacactgtgctggcctatgtgtcgatttctgctggtttcaggttcctaccatttttaagaaaaacaaaaca

SEQ ID NO: 12125 - DNA, 400 bp, Zea mays
gattttcagaaaagcttggtcagaaaaaaactgaaccaaacaggcccatattccttggaagagaactgtcatgggttgatcatatgtacactatattttgtaacactcaccagcctccgtccactctaaccgtttggacccagccagctcatgagctcacatgcctaggcgtgaggcgtatcgtcttcgacccttcgccttcctcgtccctttctctctcccagattctgactccgtcgggctcccccgtgtctgtgtcttggtaaacatcggtctctccccatcccacctggcagttgccatctcgcaaagtcgcaataacttgtcttctcgaatcggctgcaaccccaccccagaccccaccgccgccgccgctagggttttggggtgaggatcgccg

SEQ ID NO: 12126 - DNA, 1380 bp, Zea mays
gtcgagaaacgtttaaaagagaaatgagtttagtgtatcaccgagttaagccagagataggggataaaattagcaactggattcagtgttctatacagtaatcttcgtttacttttctgtaaactgttcatatttggctaagaaataataaaatactgtaggtcctttctacagtaacttaatttaaaaaaactctgtaatttataggacactcttcgactcactcctctatattaaaaatatagcacataaatatctctgacttcttgctaataatagtatacaaatatattttgcataaaactgaattagcttaattgatatatgactaaattactattattagaatggaatttaaccaatgatccaaacgcgacgtaatagttttcacgagtgaatggattacagccttaagaaatgatatgtcgtgcttatattgttagccatgctctaatggttagactagaatggtttgcacaccaattagtaggctgacacgtcgatctcactgtaataaagttaaggaggagagggatcaaaattatatgtaactagaacacaccccacacaccaccccatatatacaaaaaaaccatgcttgcacaaaaaacaaacataaaattacgaaactagacgatatccaatrgaagggacattataatcagcatacaatctgtttaaacttattcatatgatctacattgttatagagctttggtttctttataagggcataataacagcagcagcagcagtagtagtaatagtaataataataataataataataataataataataataataataataataataataataataataataataatatccgtagcagcattgatcacgttcaggcatcaacgacccaaagaaagaaaaccctggaggcccacatctcagtgagcatatcggtacccgctttgacgttagttgcacgccgggtgcccctaataatttccggatcgtggtggggggcatttccgtccagaagcacgagctgcggaaacggcaaaagtggccgcgagacatcgctgtgcagtgcagtgcagcaagcggctagtggacgcacgcgccgctcccaaccgagacgacgagccgcccaaggcgacgagccattactcccgtttccccaaatcccaccacgcaggcagtcaggcacccgcattgtttcaaaaatctcgaatcggcccctggttctggcagcgcagccgccgccggcggacggagggccctctttccgggtgaggcaagtcgaggcctgctttgcctcgctgtaagctcgccggaagagggaaccggggaggggaaaagacgcgcggcagtggtggagtggaggtgccaaggctgagggaggcgcgccgccgccc

SEQ ID NO: 12127 - DNA, 1475 bp, Zea mays
cctttattggatggaaggtcggagttgactgcttcagcttcaggtctacagaccggccgtaccgtactgtgaccaaccctatcagctgagaaaaaaagaagaagaaaaggagccatggcggcatgccggcatggccaatggctccatgagccatgaaccatccagcggggcgacagggcgtagcccggcggcgagccgtcgccatcgccgtcgccgtacgggagagcggtggcgggtcatgtggcgtgacgtgcgacagctgaggtgccacgtcgtcggaggcgaggcacacatgatgagcgaacgacgacgtcgcccgttgccgacagcgtgcgtggcactcctgagccccccggtgcgccgtgcgcagggacgctcgatcgttttcggatctccccgcacgatcccacggcacaggtgataagcgtggccaacagtaccggaggttgaggcctggatcgtcgtccctgatgattggaccaaccgatggtaccggccggacagcatgcacgacactaactagtcaatgtagcggggggggggggggggggtccattgccctgcatgtgtataccacagttcaatgtgaactgtttcgttcgtgtaccgtctgaagtctacgagatgagggtcttcgtgattgaaatagaggccggaggaaaaaagccggatgagagagagagagaggcagtttttttctaatagcaagcaagtactgcaggccgcagcaggcgtatcccgccgcgcgcgcgtgacggcacaggcaacacgcggtatcaccgctgcggccctcgggtgacgggtcgcccgtcacgtctcgctcgctcagcacaccacacccgtcgctgccatcgcgtcccctcctcgaggccggccggccggccggccgccgggggaccgcggagctgggactgggagacccacacccagtcaaagaatccccctcgcgcgcgctcccgcccagatcacgtgtcgctagcacgcctttgcgcctgatcggggccgtcacggacccgtccggccgtccctgtcgcccgcaccctcctcctcctcctcctcctcctccgtccgatcgcgtcgccaccgcggctcctcctccgacccatcactctcccgcattctcattccccgaggaccaccactcgttccgccggtccgtcacgtgtttcatgcgacgcgactcgcctcgcctccgccccggccccggcccccgaccaggctggccccgtcccacttgccggttcattggcacgcgctattaaagggggggcaaagggccatttgcgagaggaggaaaagcacgcgagagcttgtcggagggctctctgtctctgtgataaaccgatacgcagaggaagctgcggagaggtgtccctgctctgctggtgagctgcggccagcgggtgaagtgaagtggaccggacgtggacgaaggagagagagagagagagagaagaaagggcgccgcgggggcc

SEQ ID NO: 12128 - DNA, 514 bp, Zea mays
gatcacccaacccacgatgcgccctcttcgtcctctctcacctcgcctcctccctccctccttccaatctctaatgccacctcgccgccaccccctgctgcttccccccatacctgcacgccttcccaccgcacacctctctcgctaattttagcctgcggttggtggcggtggtccagcagagggagaaagagagggaacgagggatgccttgccgccatttgtatctgcccgaaccggtatgcgtgggatgtgggagggaggaggacgaagacagacgcgctccgccgtctctgccttgtgggccttacgtgggcctcatggcttaaaatgccatgccccagcaactacacgagtcaacacaggcccggcccggcccggcccggcccaagaacccccatctctcgattcctccaacaaattcccctttcccttactccccatccccacccacccacgccgacgagcaaaccctagcgagcgagagagcccggagccgagagaccagccagcc

SEQ ID NO: 12129 - DNA, 238 bp, Zea mays
agtaagtttttaatattgtgtatagctcctgaaatctgaaaactcttgacgtctgtaatcatgtgaaaaattcgtacaggtaaaatatgttagtggctcctatgatagggtggaaggatttgagttattaaataaggcaatctctgagtatgaaacttcaaaaaacaatgactcgggaagctaccgcagattattttatttggcattgcctccatcagtctacccatcagtatgcaaa

SEQ ID NO: 12130 - DNA, 464 bp, Zea mays
aataccccttaatcatgtatcacgaagctttcgaacattgacaagaattaaactatttctagtttctatatcgaaagtagttacgtcttcttagttgacggagagtcctagagtcgagacaagggagggagggagggagggagagagagagaagagcgagagggagtagtagtagtataaattttgggcaggtgtggagagcagaagcgagccaagcaaggagagcagcagcttagcctagcactgctgcagcttgcttgctttgctttgcttctccagtattcttcttggccaggcctcagagcagagctttggcttggctagtcgtcgtccgcggatagtctccgctgcaccgtgtgcgtgcaagcaaggcaaggcaaccagccagccgcggcgacgaccgatcgtcaacaagctcgatcgccttggccggcggccgggcgggccaccgcaagccgcgagcg

SEQ ID NO: 12131 - DNA, 515 bp, Zea mays
tcgtctgcgagatcgttcctctgataccaaatgttagcaacacggaagcttctagagagatagcatgtagagagaaagtagcagtaacgtggaaaaggggtcaagagaaggagaagacgagaggatatgtgataatagtgtttgtattctgataattggtaattgatgtccttctcagcctatacaaatgtacttttatagttgtagaaacccacttgctccctagcaatggccccacatggcagccactcctaacaagaaggcggcggttggctgatgagccggcggctgctgcatgcgattctttggttttggttgttgagttgtttgtttcctcgtttttttggaaatctagtttagtagtcgccccgttgttgtttgagaggaagggacacggtagaaacagaaatatggtgttgtgatttgcatcggcgcgcgcgtaagctggtgtgtttgagccactgtggtggtggtggtggttagggtgtgagctgcgacatttagcacagcaagag

SEQ ID NO: 12132 - DNA, 63 bp, Zea mays
cgtaaacatactttttttagtttagattcttatgttgggcctctaaaaatataaaagttatta

SEQ ID NO: 12133 - DNA, 1500 bp, Zea mays
gcttagaatcaagataacaccacctcacaaatttagggactgctgtcagtccatttcgttatattgaaaataaaaaactataagaaatggactgcaacaagctgcaacaccacagtttagaggagccattggcaattttgccattatcatttctccagtttagagcaaggtttcaactaaacgcatactgaagtgccgttcactttcgaatcagcagtacttattcctggcaatactctaaaatcatagaccatacttacagatcaacacaagtcttttgtatgcactttgtccctactcatgcgcacccgaaaagacttttggatcggtcaccgatcccaaaattgctctagcctaagctcacttaacccagaggttccttcgagacaaacaccttgttgatgcatgggtactctattaagccttggaccaagatatcaaatgaagacacacaaaagttccatataaacatggcaaagcatgtagattagtaactgataaatatcataactacaagttctaccaagtattattatatgcccgttgtgttagaaatgcaccagatgtacaaatgtacatatgtgaacgacaattagtgtttatattggctaagatgttatcctatgtgtgagagcgctctgattgatccactagcgttataaatatgcatgcatgggttaataatataaggatgaagttaaccaacatcatgaaacacattttcattatatgggcctttctagttgaaacaatagtacatgcagataaacgttgcttattagctatatacgaacgatacattgaagactaagccaacgacttaggaagatgatatatgaacatrcctgtaatggttctgggatataatcgatgaagaaatacccccacacagtcttcggcgccatggctgtcgtcagcgcctctatatgaaatcgagctgagtagcgtgagctgttgtgacccaagtgcgcggggtatgtggccactacaatgcacatatttatagctgctgtcctgtggctctcgcctaactacagatcagcaaataatggggttaggagacatgtgattcacaggaaaaccacatgtcgtccttagccacaggagccgattgaaaggcgcgcaacaatcttgacgacgcgcaacctgccgcgcgtgattgacgttcccaattccatttccctgtgagcacagcaccgagcggtttccaattccatttccttgtacggctgtacccggtacagcggtacccctgtctatctgcttggatccttaggccggcggcatacagccagatattaatcccatcagccatcacgattcacgccatcagcggatcagcaaagcaatcagccaagagccaacatgcgtgcatccattgcagctgttctcaagtatggtttgttagtttatttatctcctaattggtacagtttggaagtaaagtttgttagttctcatctatttatataattatattttaatattcagattacaacc

SEQ ID NO: 12134 - DNA, 380 bp, Zea mays
gaacacgcgctccgcacccaggcgcaagggtggtttggttggcctccgcccccgcgtcgcctcgtctctgggcctgctcgcctcattgccccccgtgctgcctacgcttttgccagcgcgcgccccaccaccaccgggaaaagaaattccccaattctactccacccggcgcgctctccccacgcgcatccggattcgtccgctctgatcgaggtatggcctctcgaatccgcgttagattcgtcccctgtctcttcatccgaacccgcgtgctgaatttttcgtttctatcgggtaaatttggggtggttggttgggtgattttgcataagaagtgagttgatctggactctgtgcctgcctgtgagggcgaggagggc

SEQ ID NO: 12135 - DNA, 1500 bp, Zea mays
tatagtttatttataacaaatataagtatattttccatttaagggctagtttgggaaaccccattttccaagggatttctatttttagtactagtttagaaaccttattttcccaagggatttccattttaccaaaggaaattagttcatcttcccttatgaaaatagaaatctcttggaaaaatagagtttccaaactagcccttagaattctatttttccaagggattcctattttcatatgggaagatgaactatttttccttggaaaaatgaaaatctcttggaaaaatggagttataaaactagccctaactaaacatatactccatccgtcttaagatagaattcattttaattcttatttattatatctatatttaaatagatggtgataaatttaaacgtatatattaaatattgtatgagtctattaattatctaaatctaaaattaatgttaatttaagacaaagagagtagtaaataaacattttctttaccttgtgaacattaaatactaaagtgttagggatgtttgatttctatcttagtgactaaagtttagttacttttaggggtgtttggtttatatggactaaattttagttcctatattttattccattctagtctctaaattaccaaaaaacagaaacgaaaactttattttagtttctcaatttagcaatttaaaactaaaataaaataaaatagagggactaaacattagtccctaaaccaaacaccccttagttattaaaatactaagtaaatgtttggtttataggcacaaatttttagttccccattttattctattttagttcataaattgtcaaatacaggaactaaaactcaattttaatttccgtatttagtaatatagggattcaatgaaataaaatggagggactaaagtttagtctttataaacaaacactcctaaacgaagtgattaaaataggtcttccaaatataatttttaggaactaaagtttctttctaagggctagtttggcaactccatttttctatgagatttttaatttcttaaggaaaaataaactagtttcccttggaaaaataaaaaatcattaggaaattagggttttcaaactagccttaaaatataagaggatgactgaagaaaccaaacacctgcttacattattttgaaacataatttagtacacggtttaaattttcgtacaaccgaggagtgaaaaacagacttgtgctaacatcccttgcaaaacagaacaaaatcagtaaaacgacggaaaagaaaagaaaaaaaacaggaaaaaaggccctcccctccgtcgccaatcccaatcccgatctccaagcaaacccacctccccggctgtcccccactcgccgatccagatctcctacagctttccactccgccactccaaccggacgcctccgccgtcgccggcggcggtcgagccacgcgcgcacgccgctgaggaacccggagagggcggcggca

SEQ ID NO: 12136 - DNA, 1500 bp, Zea mays
tcgggtaactgagaaccgctagtgtaaacccctaattaaaatatacttttgctatttaaaacacattttgtgtttcatagaaaagattttcactatgctttattgtcaatggaaacctggcagtcgaggtaataaaaccgttagtaaaaatattttccatgaaacatataacgtgttataaaatagcaaaaaatattttaattatgggagggctcacacatagaccatgtctatctatgtcgaaagtcacggaacaacctcactcgcgtgtaacccgctttcaccactctgcctatcacttactttgtgtctatattacagttttgttgtccacatattatacaaaattgagtgtaaattgattgtttgaggatgtaaacgaattcaaacgaaaaagttgtcaactacaaagttttataacttttgaagttctacaacttttattctgtactttttcatctgagttcgtttgcaaaatttgcattttaaatgtgacaaatttagatgcactttttgagagccaaaatgattttaaataaaaagttgtcaactacaaaatttcataacttttggagatctacaacttctattttggtgatttttttttcatacgaggtcatttgaaaaactcaaaaaaggataaaaatgttttctagcagtggttttttttcagaaaccgccactaaaaatagcactaacgtttgataactgaaaccgcctgtaaaaatcaaacttcacagaagcatttgagctcttttctgctaatggataaaatatttatcgagtattatttgacctttgacgagtgtaaaagggtcttgttccccggtggcaaagaagtcgagtgtggtgatacataacttgcacaggatgcatacgggaaaggtagtgtcctttagcgaagatggcgtgttggtgatgacatataacttgttgaagcgattgaaagcttgttggtgatgatgcgcgtatacagtgcagttgaatttgaaagctagttgaggacagatgagacgtggatagctgactgcaggagaccaaagctactgaggtatgtatagattcaaagttattagctggccatggatgtcaacatggtgaaatgtttaagccgttagctgcggtgcgtgtgtctgtgtgtttaaagctagctggcaatgcattggcagtggatgacgacataatgaaatgtagtggcaatggatgtcaacatgatgaatagtagtttgcgtgtgaagattcgaagccggccagagtgtggattttgtttttatatataggattaagttcgtagttaactaataagcaaagcacactgagaaatcttgttggagcgcagttaatgcatgcacacgtacgcacgcaggaagcttgttgctgactacatatatgtttcatgttttttttaccactcttctgaaggcccaaattaactagtgcgtggtctggtctccatctcgatcagagagctccgtccgtcactttcccctcgttccattc

SEQ ID NO: 12137 - DNA, 1106 bp, Zea mays
ctgcagcagtggcaccggtccgccctcgcatctcgtccagtagagtcggctccttcatccctcctcccgtgcagacgcgctcggcagccagccaccagctcccagccccagcagcgcccagccctccgcccgctagtagcagcgacagtgcgtagccttgcaggcgcgcacagcgcggcccctgccctgccccgccctctgctcgccccctgccctgagataaggattgaatagatagcagagtttatgtgagttgtgatttagttctagaactactagttttgtatttcttgattgctccaggtattgatgcccttgcagttgcttgtaggaggtggatgggatattctacacagtctggtggggagtaatgaatggttcatggcacagcctgctatctcagtttctgatagtagggccattctgctgctatgtctacatgtttttttatgtgtcttcatgtgctgggaagatgaattggtaggagactgacttgttttcatgaactaggaagttggacaagtagtaggccagcatgacctttatccaaagatcttttgtctctcatttgtgttagaaactagctacatggtcgttgcttgatatgttaatattactagcatgtcacacaatgttcataatggatatctcgatcaatcatctgtttatcttttacagtttgtgtgcctcgctcagtgactgatgatgtttcaagccatatttgtctgtttatagtttctagcaaggtcaaaaaacttacccctgttctatgattcagacttcagaggctggcgtagccatggcacacttaaatttaccctagtatgcacatgttgatgcaatagtaggaaaataaacgccttgcatcttgggccagattagagttttcagcatttgtttaagaaactgttggagtatacactataatttacctctaaaattttttagcctgcccccaatagttaatttttgggaggatatttttagcttcctcttggagttgctcccaagtgactccaacgtgccgtctatataaagcaccctactctctatcgccacttcactcgggtccatagttcaaaacgaaaccaagcaagctttcggtc

SEQ ID NO: 12138 - DNA, 1447 bp, Zea mays
gaagcactgagttgtagaaggtgcaagtgggactgggaggagatgaggtgcagaaatgccaaatttgactctgtcctggcgagtgaatcgaacctggttttgtctaatgcacagcatttttggtggcgatgccgtgttgttaatcttaggagcattttgccttcccgtccactgtggttgcaactaggcattcatgctactgtagtactgtatcctgcgcctaataaccatatacggttccaggctgcagccttaaaaaacacatctactgtgtagtatatagtagtaggtgttaggcacccatctccatgcacgcatgactgatggcaatctcaaaattaaggactgctgagagagggttaaattagctttggtyatgcagagcttatctgatgtagcatctcttttaatttccgaattacatgcttgcattggggagggacgaaggtaatttttacaacttgtgcttatcctaatccaaaggcctcaataaagtgacgccgtgaaaggagcgagcacttgtagccatgctgcacaaccagacaacaatagcaccgtgaaaagaaatagccactgcacgttgtactctagtcttgcactaataagcactgcctcgcagtctcacgaagcgtatgacgttttggataattacgtggtccagttgcgtctggagtacaaaaactgaatcgtggtatagaggaatctccaccgatcgagatgctacttactttccaaactatataagacatgttgtctttttttatagatactggtttttctatatatgtttatatttacgttatgtataggtaacagaaaaaaaatgcatctactacaaacaccaaaacatcttatgatttagaatagagtaaagtacaggacgaagaaaaagaacataacataaatatatggcatgtttagaagaaaaaaaagtatttcaaatatatggttttggaatactacaattttaaaatgtcatgacataaccgtaataatttttacatcactctcaacaataagtgtttgaagacaaagtatctcaaaccatgatatttagtatataagtggaaggatagtcatagacaaaactttaggttagagtggagtttcaaatactataaaaataccatggtattcaaaacaaagttttttacaatgttgccaaacactatttggcaaaaaatactatgtgttcttaatactttgcttccaaacatctcctaaattttattgattatgattttatctcgaggtataagtatggataaacatcttgtagcggatacgtacccgttccatctcaagtgaaagagatgacaactgtcctaacaaacaaactagggctcaaaactaacttcaaaaaaatcacccactaaaagcaccttcctcttcctcttcctccgcccccaatccccctcgtctcacaaccctagctgcccccgaatcc

SEQ ID NO: 12139 - DNA, 1437 bp, Zea mays
tcaccttttttgatttctatattttttctttagaattccttcaatccaaacggatctaaacatattttcactcgtccgatcaggcgattcagaggacgacatcgctagcacgtggtgtctgttccggctaaaatgaaaggtagtggcaaaattgtggaaagcaccagggaagattttccgcggtggggaaatatcaagaatacccctggcatccgcagccctaacaaatcaaccccgcttcgtcttcccctcctccttcccttcttcccctcccttcccggccgccgcggtgcgcgcccgcctccttccgtccggaggcaactactcgcttctctctactctcggggaagcctgagctgattcctcctcgtgctctctcgtgggtaagtaaatccttttgcgcaaccagatttccgggggcttcgactgaactgagctcttgcatccggccccttgttcccccccacccatgggtgttgattcccaatcctccttttccgatgacaaagagccgtcctttttttttgttcagttggtataaagtaatttctatttggatcctcgagtgggcttgcgtattcgcgtagcatcctctgaaatttactccttttcgccgtgcctactgcctagcagattattttgtgtttcccgtccctgctctgttcgcagtcatgttgcgatttgtccccattctaggggattcttgagcaaaatgcccccttttctctatttccccttttttctctccaaatttccatcctgagttactttgcttttatactagttatattatcatttcagtccttctcctgctggagcttagtggagttccagccttcagacattttttttcttgtgaatatgtcagttcagtcatcaattcagtgttcgtttgctcggaattccttggcaatttttagagctacaagagcaacagtccatgataaagttttagtgaaatttcagaggttcatgaacaatgctagtatgaatccgtccgggttgaaatccatgtattgtgtgactgttctttttcttttggttttgcaacaatctttgccaacgttaagcagattttgttaaaacctgaaccgacatactgcttcattgctgctgggctatatagcttttgcagtggtgccttcgtcagacaaatgaacatgaactatcatctccatcatgtgccctatttacctagtaattgtgtgtttcctgttctatgcctttaccaacaaaaaacttgagtcccaggttctctaatgggagatgttgtatgttgctaatgacctttaaaatacttaaaaaaataggcacccttgacatagtgaattttcacttcgtcatgaattacacatgagaatttttgttgaaagtaaatttcctttacatttcttatgtttattatagttatactgacagctgaacaactcaggaagc

SEQ ID NO: 12140 - DNA, 563 bp, Zea mays
acgatttgtattcactagcatcctaccaagctgtgtacacacaccgatttatttcaagttcattacgccgtgcatcctgccactcatgtcaagagaaaaatatgcacataactcatttaattgtaatggaccataaaaaaacatatccatgaaaagcaaataaaaacaattccaggttttgctaccaaacccgtcgatcgggttcagacctgagacaggccattgcgaggttggcctctgtcccgggcccccgctgtgcccatgagggcatgtggatgtaacacatgtcacgtcgccgttgattattagctcagcaatcttaccagggtcaaactgtgttcaattgccttctcttcacttgttgctataaagctccatcgcgctgtgcgtgtatatatatgcatcctgcccccaccccccttttacctccccactcgtctgcaccgaatcggtcgatcggtgcttttaatctctgagcaagcgatcgagctcaccaacaaccaccgcgctcaagagtagcagcccgccggccgcgccggagccgaaaacgacgaggcggtggc

SEQ ID NO: 12141 - DNA, 366 bp, Zea mays
atactccatgccgtccagtgcaagcagctgggttttcaattttgtcattaaatgcagtacgtttcttggccttattggttttctatgaccacgtgaaacacgcgcgtagatgcatagccttagcactatcactttccttacgacttctgaatcgacatgcgtccacgtagaaccgtctctctcctcgtggtccatgcttgggaggacagctagctaagtccagaattatgaacatcttctcaacaagcagtgggtaaggaacacactatatatatgtattaagccaagccaagaatgcacgatccaggcatctaagcagaccacacaaaattaacaacacaaacaggatcgatcgagcaacgtaca

SEQ ID NO: 12142 - DNA, 1500 bp, Zea mays
cacccaaaaggatcatcacyacatcactttctctaaagaattctagctttttttttatcgaaatcccatcagcaagcaggtgtaaaggtgatgcttgggcttcggctagtggtaaagaacagatcatttacctgtctgttgacatgtacatgtaattgtcttacaaaatatttttttgtattgtagactctactaatattagagtaaagtttgaatatagagatggagataggtaagctgttggatagagatagaacctaagagcatcttcaagagactctttattttttactctctaattgactctttatttgtctttctataaagattaaactatatatataacatctcattccaacagactcttcaaaatacaagctaacttggctagcaagagttgctagccaaatttggctagcttggaagtcaatttaaagagccagataacttgtctagttaaatagctagcctgttggagagctattttactattaagtagctaaaatttagcttgacaagctatttagctagtctcttggagatgctctaagcaattttagaacatattatgggatataacaagtggcgtatataatttttcctgattactatatttagattggaggtagatattgatggtatataattttggataaatttgaatgccaagagtattataaactgtgtgcgttgatatgtcctcgtggtctttgcgtgacagaaggaagtacgagatttaagttgcagcagaacatgagaaatctcaccgcatgtcaacaatttcggccacgtggtgaacacaacaaattgtattgttgactcgaattaggtttatacccggttttataattggtccatgtaattttggcctaataatctaaagaaaagtatgtaaaaatacaatatcacaatgactttagctttacttgattgatttcgagaaatcagtctcgctgttgaaatccttctttgctacgtgctattaatatgtagtccaaattagcatcaacacaaatgaaggaaactaattgctttgatctgcaatcaatttctccttgtttttcctccggttgagcagcaccgctacagttgtcattgctctactctgactgtgatgaagcctccaaatatatcttttatttttcttctgccttattcttcttactctttattaatttctagattgttctactgctataaaaagagatatatctcatttttaacaggccactaagttgtttccactccagcatgggagggagtgaccgcggacggttgtgggctgtggctttatttactccttaagaatcgttcatctctgctgaccccccctccctcgtcgtcctccacgccgctctgcaacgctacggatgcctcacaattaaaccctactctttctctctctttatttccggctgcctctctacgcacgaaggaagaaaaaataagcggaggggagggagaagaggacgagaacaaaagacaaattctcagcggtga

SEQ ID NO: 12143 - DNA, 608 bp, Zea mays
gcactcagaaaaagagcattctttttgtgtcaaaaagaagttaaacagtttagcatagtatttacactcacacagttgaaaaaaattcaaaacgctgcacaagatgtcatgagagtacttttgcaagcacccgtgccatacctctagctggtccttaccttcacatctggccccacaaggcagcgtcacggcccgcgtccacgctgtgcgcctaacaataattcgcgaatcatggagcaagggaagggcagtttcgtcaaaggaatccaaaacagaaaaagctcggaaacggcaaaagccacggcgagtagcgcagaggcggcagggtgggcgaccagtctcttcggcacgcttcccaccgagctcacacattgcacattcccacattcccattcccacctgtaggttcacgggaggcgaggaccctgccccccctgcattcttcccgtatcgcggaccgatcctcgccgcgggaggcgagcggagcggggcgtttctgcgggggagaagcgcgtccctgcaatttctgagagaggggaggcggcgagtggaaaagagcaggcgttgctatcctatcttgctgacacagcggcggtgtggcgaggcgc

SEQ ID NO: 12144 - DNA, 1121 bp, Zea mays
tttgcaaaaaaaaaaaattaaataaataaaaaaaatcaagcggttgtacggtgacagaggttcagtagatcgtactgatagtttgtttgcttgctattacttgtcagacaatgagattactgactgcttcaaaagttgattacccatgctacgctgtgtcactgccttattttcccttttgaattcagttgctcaggaattgcggtacccggtggtaaacccaagaggtgtatgagggcaggacagacagactcctctgacaaaccccttcacaattcacctctttaaggtgctgctgctccagaaacaccggcatgagaagaattggctctcttttcattcgtgttcaagatagtttcagaaaatccagcagctttgcggttttcgatagttagatcttgtgcctttcttctgacacgaaacagctcgtgctggtctttcagcttcagaacttgcaacttgctgaatgtgatttttgcgaagtgacatcgggtctctagtcacgagcttcatccctatactcaccatgtactgataaggagaatggacgttgctgttttactttgtaccttttgtccgtgataagatcaaatgtaacagtcaatagtcaatgcatgctgatcttaggtttcagtcaggacctgaaaaccattgtaacaacctgtatatgctattctgccgaagcctccacatgattttgttaggacctgaaaattgcatcacttgtgtgctgattgctgaarctctccacatgattttgttaactgacagccccatggtatactgttacgtaaaagcttatctgcaatatcaattttgtataattataatcaaattaaactaatgaacacaacagggcgtttggtctagtggtatgattctcgctttgggtgcgagaggtcgcgagttcgattctcgcaacgccccttttaaatttatattttttgcttcatttaattaaatatttaaatctatatttttgcgttgtcctcgcttggttatacaataaaaaaaaatcttgcaagaggccgcatgtggacatgtctactcggaccactgcgtttaccattacctacacggctacaccgtcgcctaatttgccaacgcccgccgccgttccg

SEQ ID NO: 12145 - DNA, 676 bp, Zea mays
ttcagttagatctgaagctcttgcacaaagtctcttccactagatgggcataaaggtggattaattaggacttataggctagaactcacaccacaactaactaataggtaggctcaatatgccgctggattaggacgctgatatgataacaataataaaaatggtttatagtggtttgaccgtgtaagcatgcataatactctacatcatctttatgatggatgggtaatgggttgatgaaaatggagatgaagattgcatgcttagatatggtatactggtatgaacattggaacatgcatgaggaccgatcgactagctccacctttatttttattccgttgagagttatcgtcatctaagtttttaagaagcgtaaaatctaacaaagctcggactaagagcatggatctgaagccagcgttcggaaccttcggaccctcttctacattgctttaaataatatgacaatatcatacagctaagctagcggtactggccatgtttgtgtgactgagccggccagctccgccaatcccgttggcttggctgcaactaacgaattggctataaatatcagcagctgcgggcttcagtgctcaaccaaagctagctactttgttgctgtttttattcgtttgtcacataagcagtggtggtcggtcggccggcgaca

SEQ ID NO: 12146 - DNA, 136 bp, Zea mays
attacttcactttcactgtgtgtaataattaataataataaaacaaaaacaacgccagcccgtacgtgccgtgtgaggggggcacgtggttgtggctatactgtagccgtcaccaccatgtcggcgtcgtccatgc

SEQ ID NO: 12147 - DNA, 155 bp, Zea mays
cctgcaggatggctacaatggaatcttttagcatataaaatcttgttcattcatcacatacattggagataaattctacatacgtacttgagtagaagatcaataatgcaaacttctaacacatgagaaaatgtaattaattttatgcaacagac

SEQ ID NO: 12148 - DNA, 526 bp, Zea mays
agagttgaggtgccaactctaggcatgacatgtcctgtgctctccatttgcttctctgaattccctccttgtagcgttagacggttagactgtcgtattgcgatttcaatggattcaactgagttcagctttaagaaaacgttaatctgttgttcccctgaatgttgtgacttgtcagtaagttagcagctgctagccaatcttgtttggacggtcatacattcatcttaaatctttatgcattcatcttaatttatgtaccttggagtgatttgatatttaacctaaactaaattctatacgtactaaattattttaatacgtatatatagagagaggtgtagtgagagaagtcctgagaggtgggcggactagtgggaaaatgaaaatggaaatagaagtagatggaggcaaaatatcagtcaaattttctctgctaccaccaccacggcaccgcaccaccggcggctgtagactgtagcacgagagagaaatctgtagcccagcagctcgtcactcgtcaggc

SEQ ID NO: 12149 - DNA, 1500 bp, Zea mays
cttcatataaactaccaacaatcacatcttcgctaactattacatgttgaaaactaccgcacttgtgttgacaagattcactttaccaagaagttacactcattcaatactcatgaaaatgtgcaaaacatttactacaataagtgtagagcatgaaaaatattttcaagccaatacaactcaatttgatgactcagacgtggctatactcactcagattttgctatatggacatatttcaatatattaagttattcttcttcacattggatcaaacttggaatcaacttgtttgaatacttccaaaagacatctatccgttaaatcgtacttcattacaaagcagagttgaagtggaaaacatgaatgtggtgtgctgacttcgcgataaagcaaaggcagaaatgagcagaacgaagttaacttgtggtaggcacgaagcttggtctcgaagactcatctcacaaagttagtaagattgaactaagacacgatgtcagctatgtaacgaccaaactgtcctcggatgtaagtaaggtcctaagtatttgttgcgatcattttgggatataataaagattgtattaggaaaaataaggagctagaacatcctctataaatacccctaggatgtattttcttggacatgaaatatttattcgatgtagttaaatctacttttgatgctaatagaaggtgcggataactctttgaaggccatccaaactgatgatctatatctcttatgtaccacaaaaagtgcactttagtgccattattttaattctacaatcttctttatgcaagagaattttacccccttctatcttcttgctcccaaacacgacctagatgtgtcaggccgagtatgagcttgtttgtggcccaaccacgccttagggatattgtatttttatggatctacaaatagtcaagcatcaacctttaagaaatctactaactaggacccgttaaatttgttccactaacttgtacgtacactgccagcgcccatattttcctatttgcaatacattccactaataacacatgttggcatgctccattccactccgttccgtactgatttgccgtaaacacagagcacacatgttgaaaagaaaacgaaaagcacaggaagactcaccttttgttttgttttatatatgcgctccccgtctacttgcatccaaaagaactcctgggaaagaaacagagataaggagaaagacgggtttcttttatcgtcgcctgtcggacgtgctctgctgcagagtcttgcttcacccgtccggcacctcactctctggcctgctgtatatatccacctccctccggcctccatttcttctcgacttgaacacggccagcgtctcatcggctgggcgtggtctacactgcacgcacacttaccaccagccaccgcaagtgaatcactagccggaagacaggccaaccccactgctagtgctaggaatctaggagcgagaacgagagacc

SEQ ID NO: 12150 - DNA, 189 bp, Zea mays
ggtaccacaccagaaacctttctttcactttatcccctactggctattatcgcgcacctctgctaaacatctggtccgaatcttgcaggcgaccacttggtgttcttcatactgaacatcttcacgttcatcggtttcgtcttcaccttcagaccgtttttcgttcgaggcagtgccaagcactgaaac

SEQ ID NO: 12151 - DNA, 1500 bp, Zea mays
gaggtatagctgcgcagccagtccacccacatataacgggaaatccgttgtacaatgaattttttcatgtaatcatcgtgcaactaaactactaaatgccgtgaaaaatctcaaaaaaaaatataggtatacttcgttatttattctatcaatatatcaaactattatattaagggatgtaaaaaaagagaacatcttgtcattatctcgagttcttattagataatttgctaactctttttttattttaatatgacagtggcctcaactaaaatattcttccttctaaaattagaattgtttaaagatttatttgagacccgtctcaaaaaagaagattaaatggtttaacaactttatgtattcagaaaaaaataccagatgagattaatatgtataaattcatggtcactgacttcgcatttgcaaatgttttgaagaaaatcttaagaaaacgtttgtatgtagtttgtttgttaagaatgtctgtgtgaattttataagaaacattattagctcggtttttagctgtctcatgccactaaattggccggaccgagtatgaagcgattttaaccttagaagaagggctagaactagggttatctcaggagttggaaccttggagtttggctctaataccagtaattgctcactacatctcggtaacatctctgtttttttttggcaagtgcagcttctctgtttatatcgggtaagacaaaagagaacgccaaacaaaagagtattaaaagaaacatcaatcaaaagatgataacgtggacgtggatctgggcagcaaattgacggggtttttccgcctttttcggttacaagtggattcagtgaggttggagaagattaagggtctgtttggtttgtggctaaatgttgcctaaggttagtcgttcgaattgaataactaactttaggcagaaaagttaggtaaagtgtgacaactgaggtagtgaaccaaacaggccctaaatcatcttatagtcaaaattaaattggagggagatttaatcccttcgatccatttcaatcttctcgcaagtgaacaagccccactgggctccctgtatccaaaggagattgggccggtatcccgactgtgctcgctgtatccaaaggagacctgttacctgcagcctgcaagcccagccttccctgcttggcttgcattccgacctgcttggcttggcttgcattcacagttgcacgccggccgccgccaaccccgcccccacgtcgcgcgcgctgtctccctctcgcctctctcgtggagacgactgggcgacagccgacagccgctgtcgcccaacgcaagctgcccaggtcttcttcgggctcttcgccggcgacgagcacagccaggtacgctcacccctttgccttcccttccctgcgaaaccaagcacccaaaccttgtattcgcatctgacctagtgacgcgttttgttgggctatgtaccttaggtttaggtcgagcaggggccg

SEQ ID NO: 12152 - DNA, 98 bp, Zea mays
acttccgcaccggcataatcatgaccctgcccgtgcttttcgtcactctggctgtgctggcgtggcggctctctgtcaccttgtagcgagatattgat

SEQ ID NO: 12153 - DNA, 1500 bp, Zea mays
gacgagcttagtttttagtaactgcagtagaaagccggcaacgcaggcttgcgatggttgggatggaaccaagtgttgggcgctccgtcctcccaacccgcgcagcaacgctggttgacgatgcatagcataacggcagcaccgcgccgcaggcaaaggcgtcgtgtgggggtggggtgcgtgcgaggaaaccggggggcgcgcgaaccagacaggcggtggtagagtcacgttgcgcacgcgggggggggacgcgtacccaggtgcgtgcaggtggcgtgccgcgggcgctttcagcctttcactcgacagctctcgcgtggccggcggcgaagcggtgctcctgggtcctggcgctcgcggcttctacgctgccacgcgaagctgtactagtccgaatcaggtcaggtacgagctgaggtgcatgctgttgcatggagacactactgcctccgtccaagtccatgcatcatgcatgccgacaatatgctggcgccgtcctgcgcagcaaactcggttgcctcggcgcgcgccatcgctcctcgtctcctgcacagcatagcatagcatagcatagctcagcggcggcatccttttcggcatgcatgaacaggctgtgtcccgcgtgctttacattcgaggagagcgtactataaatttcatcccaaatattctctattatttacattgccctctaaaagatttcattatctatattttcttcatctccagcaacgtcctctatatttagtcctctatatctacagtagtatcaaacttcaaattttgcattatgtttcacctataaaaaaataatttcatatgacatcacgttatgtatagtcgtaatcgtacatgtggcagcatgtatccatcccaccctgtacagtcgtaatctttttttttatataagaaggacacaagcacattgaccgtcaatgcaactgtcagctatacaggacgcttcttcgcccgctacgtatagagaattcttggcgagcttaaattttacagtctcctttaacgaaccttgttggaggcactacgcacggttgcatccgttaaatttagcgtagagaacgatttacagatccttgctggagtcggccttaaatttgaaaaggtttagttttcttaagaattgatatgtctaatattctttgaaggaaaaaactatgttcatataataaggtctccagaagccatcctatcttattttatattttactcagtaaacaatactcgggtgtacagtgttttatacgaccgatctggtaaaaatgtggagacgaagtgaggaaccttccgcgcgcgccctctctctcccccttaactgctctgaccaacccccaccttgttccagctaccctgttccctcttcgtctcttcttgacgccttcaagctcctactctccgagcaaacctctccctctgcccctccgcagcagagcacgaatagaatagcacagtcggcgaccagaggaccagccactgtcggca

SEQ ID NO: 12154 - DNA, 183 bp, Zea mays
ggtacgaataatctaagattgtgtcgctgatgattttgtcaagaaagaagtctagaatcagacggcaggtcattgcgcaggactcaatgttccttattcttcatccaggatgttaattgaagtcattatcaacacaagttagctgtataatcaacctactctcttcgcatacaatcaacatct

SEQ ID NO: 12155 - DNA, 359 bp, Zea mays
gtcaatcatgacggggctttacgtccgtcgtgtatcgygtttgacttgctgattttcgtttgtcattttgccagacactaaaaaacatgtggattgtgaaataacaccgcagaaacaactgcaactacctcaactgaattatctgacggctgagggctagttcgcgaggactgtaaacaccaaggggcttcctgctgaaccgtgcaagatttttgacgtgtcagacagatatttgcaccgtccaagacctctgctgctggcctgtcgctgcgtagtgtagtgtcatcttatctcttcctcctaccttcactctcaaaatcttcagggagtcgtagaggagcagcaggtgcaccaaaagg

SEQ ID NO: 12156 - DNA, 1500 bp, Zea mays
atttgtttccgccaattattcgtcgataaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaggcggcgggatctcttggtctgcagtcctgcttcacctcgatggatgatgtctctgcgctgataattattggatcaatttcgataattattagtagatctatgagatatgccgcctggaagaggcgaggtaagctgcagcatgtaaaagtctgcgtgcgtcgacagcaaaaaagagaaaaaaagatgtgacatcctagaggaggcctttgccatgatgggtgcgctcgcatggcaggccaggtattaataaaaagatgattattgtgtgccgggggaggagatcgcacgggggttgatgtttttggccccggggtctcctccctcatcttgttccgtgttcctgtatccgttgtttccgcgcctgttggtccgctgcgcacgccggatttttgcatcgagcacggagatctacaacaaaaacatggagctacgacgcgactcccaaggtacaatcggtaattatgttcaaacaatttttaagtcgttctgcgctccttctattacgagcaacgttttatattctgtgcttgcataatgaatcgaagaaatcctgacaccaatcgaactgaagatcctgaaacgcacgttaataccgttgacgtccgcttcacccagctcgattttcagtcttgtaatactaatcgctccatgagtctgaagtgtgcaaaaatttaggtcgcagctacacaaatttacatgctggttctgttcaacccgtgaatctcctattttggaaaggtcacagcgtttttatttcattctatattatatttcagtctggactaatgttgagatctccatatgtatctacgtctaagcatttttcatttgtatttaccatgttggtcaattgggatatttgtttcttgtatgttagcatgtttgaaccatagcaattggtggacgtgtgtagagaagattgcaaaactgcagtatgatggattccactattcatcaaccgagatcatggcgcgcttcaatcgtggctacgctgatggggaattgatccgttatggctcgtggctgtggagatgtggaactcattggttatagtgtgcttcaatc

SEQ ID NO: 12157 - DNA, 1500 bp, Zea mays
taagcctagaactggattccaggtgaggttcaaagtcgcgtgctacggggtcaggtagtagtaaatcgtaggccctgcagcgggggaatcccgagacgggaaactacgaaatcaccgagatacgcttatttatgattggttcatcgtgaaataatcaacccagagaacaaatcactggtacgaccagcacgatctcgcggcagattagtcccgagtaccccgatgtatatattctattggcatgcggccggtgacaattctccgccccattattctacacgggttagtcaactttgccaatgattcgctgtgatcacgagacgcgtctaaagcagtttattttttattattctcttatgtacacaataaataaataaatataaaagagaagtggagagggttgatcacccagtgtgattttttcagagaggagattcgaaacgaagaacaccaaagttgcacaatgacaggattgaatgtgcagtggactgctgaggctggaggattgaacgtacagtagttatctcgcatttaaagtggctataggtgtcggaccgattctctttcccgcttcttcatgccagttgtggtcatgcagcctgtacttgtcatttgtgtgtgtgtgtgatgcacgttagcctgacttccagttgtgcgtgaccactaactttcagatgtgcttaaatgcaaacaatattgagctcccatgcttcatgatgttaccccaaaaacaataccgtcctacaatgcttggcacacaggcatttgcagcccttactcgaagtggaaaatctacacggtactcttcaggttgaaggtatggaaaaccttgggtatttgatttgaccaggagcaaagtggcagatcaaatgccacttgtttactctgagaatgaacgtcaggatggggacagacaccgtcgcccgaccgctcgcaaccaatgcacgaatatgctggcccaagtgacttcagcattcacagcacttagcacaagatctcacctcacattatattgtcctccgccaaagccaaatctctctaccatctccactgaacaactcctacgccattcatttcagggaaagaaaaaaaaacacctctgaagatgcaatttacaattcgaaaacagtcaaatagaagttgcaggctcacatcatgtaggaccacagtttgcaaaatttccataaaggttacatcagatagtctcaataaatatgcctaatttctgggagattaataacgtcgttcaaagtcaccttatttttgcctggccattaacaatttctgaaaattctcatggctcataattgtgcgcagaatgcatttaacctagtttattagcgaaccttccgactccgccctgtccctgtcacgtccgtcaataaaggccctcatcacatcaccagctttgcttggccagcgcagcgtggtggtctgcgtgcgctcgctgcatcggcatcgcgatctgtggtggtggcggcggctgtgcgccagccagcc

SEQ ID NO: 12158 - DNA, 1500 bp, Zea mays
ctctttttgttgaaaaaaaagctaaaataaaaaggaaataagttaaaatacaaaaacgtgccatgacccgtctggaataagttaagtcgatcagccacctgtctgaacatgagctgtaaaaaccaagagaaaacaggcgagagtaataagaattaaaaaaaactgggcggtgaagaaaactcatcccatcctygggctcatctccaaatccagcaacgacgggctaagcacggatctactactagctagcatctacctcatggatgatatggacaaaccaaaaaagtttatatgaacagacaaattcgcgcttttgggccaggcggcacaacaatccggagagcgcgcgcgcgcgcgcagcaaaagcggagaagggcccccgatctgaagccgatcccggaacggtataaacggccgcctytactagattagtaggatcagacacagtacgtagatggaaactacgtgcaggtgcaggtgcaggacagacaacacgcatgctttgctttgctttgctttgtgtgggctcctccagccctccttagctagctgtcgattcgcaagcacgactacctgaacgaaacacggacgaccatgtggctagcatgtacctgtacccactgacgaatggactgagctgagcgcacgcacgcaccgtaccacacgagaggggcttgacacgcgttgcgcgctcttttggttagcagccagtcatcgcaaggcggccagcggttttggcgagctgcgtgtgtgtgtgtccagtgacaaggtttcacgcggcggctgggtggtggtggactggtggtggtggcgcgagaggtaggctttggaattgcttcgcgcggacgaccgccgacctcgccctcgctttccctagttcccagtttagactagtagtttgtagtttccgtgtccgtttcccctgtccgcgtccgtgtctatataaacggcatcgccccgcggcttctcacaccctctcctcctcctccctcctgccgctgctctctctctctccgttcctgatcggcaaggcaacttattgaagcagcctctctccctcgacggctggacctcaacaattgtttgttcttgaggcccgccagaccttaataatcttgctggctggctggctggtaacttactaatctagctagctataggcggctctgaccctctgataatggtcttggactccatcggcttcttcttcgtcgtcgtcatagtcatcccccgcgcgctgcttaggaagagcttctatttctggatcttccacgtcttcaacagatatcccctcctcaacctcctcctcttccattgccagccgcgcactgatctatctactaaccgccgctctagctagcacacagcctacacatacgcatctgctgcctgaaatatttgcttggcagagttgacatttacattcgatctctcggttactagtgtagtagtagtgttggatcggcagcatttatttgcttccccctgccgctgccggcc

SEQ ID NO: 12159 - DNA, 49 bp, Zea mays
cgcagcagcaccaccaccagtgttgaagacgaaggggccgagaagatag

SEQ ID NO: 12160 - DNA, 1500 bp, Zea mays
tgagggatatactagtccaaaatgagctctaaatgcttcaacatcaagttttttgcatttaaagtaaaaaaacccttaaacatcaagtatttgaagattggagggagtagttagtaagatacggtgcgaccagatttttttgttgtattttagttatttttccgaacaattttcacgtttagacctatagagtacttaatgttgttttatgattttttttagcgtcatagatcatagcgccgagataacacttatcggcgtcatgacctatagcaccggtcaccgcaggcacaggtgggctggcgtggcagcagacgtaactctttttgttgaaaaaaaagctaaaataaaaaggaaataagttaaaatacaaaaacgtgccatgacccgtctggaataagttaagtcgatcagccacctgtctgaacatgagctgtaaaaaccaagagaaaacaggcgagagtaataagaattaaaaaaaactgggcggtgaagaaaactcatcccatcctygggctcatctccaaatccagcaacgacgggctaagcacggatctactactagctagcatctacctcatggatgatatggacaaaccaaaaaagtttatatgaacagacaaattcgcgcttttgggccaggcggcacaacaatccggagagcgcgcgcgcgcgcgcagcaaaagcggagaagggcccccgatctgaagccgatcccggaacggtataaacggccgcctytactagattagtaggatcagacacagtacgtagatggaaactacgtgcaggtgcaggtgcaggacagacaacacgcatgctttgctttgctttgctttgtgtgggctcctccagccctccttagctagctgtcgattcgcaagcacgactacctgaacgaaacacggacgaccatgtggctagcatgtacctgtacccactgacgaatggactgagctgagcgcacgcacgcaccgtaccacacgagaggggcttgacacgcgttgcgcgctcttttggttagcagccagtcatcgcaaggcggccagcggttttggcgagctgcgtgtgtgtgtgtccagtgacaaggtttcacgcggcggctgggtggtggtggactggtggtggtggcgcgagaggtaggctttggaattgcttcgcgcggacgaccgccgacctcgccctcgctttccctagttcccagtttagactagtagtttgtagtttccgtgtccgtttcccctgtccgcgtccgtgtctatataaacggcatcgccccgcggcttctcacaccctctcctcctcctccctcctgccgctgctctctctctctccgttcctgatcggcaaggcaacttattgaagcagcctctctccctcgacggctggacctcaacaattgtttgttcttgaggcccgccagaccttaataatcttgctggctggctggctggtaacttactaatctagctagctataggcggctctgaccctctgata

SEQ ID NO: 12161 - DNA, 356 bp, Zea mays
ttgagctcgcttggatcgatgacacacccctacctagcgcgcctgctgtcgatgttttgggtccgaccgcgcacccggggttacccctcaaggtgcttttaggagtaggacggtgttaccgactgtaactcgatggttcgtgtcgatcgcacgaggaacagtggacaagatttgcaggttcgggccgcttagagatgcgtaacaccctacgtcctggtgagtatacgagtgtggttacaagagggctctctgggttgaagacacagagagttaatgagggtggctaagtaaaaatagggtcgatcgttctgaaggggtgccccctaggccttatatactcgaccgtggggcagtac

SEQ ID NO: 12162 - DNA, 1500 bp, Zea mays
actctctttatgcttcaacatgtgtgtttgacctagagatagagatttgagtttgatttgcaaaaacaaaccaagtggtggcaaaggatgatccatatatgccaaaaatgaatcaaaatagatttgagttctatttgaagtgattttgcacttgttctagttgctttatgttgtgttggcataaatcaccaaaaagggggagattgaaagggaaatgtgcccttgggccatttctaagtattttggtgattaagtgtcaacacaagtgcttaaatgtgaatctatgctcatggattgacaagttgcaaatcacaagtaaaggtatgtttctaagccttggtacattggttttgtgtactaatatacttgtctaagcgttagaaacagagagaagaagaaagaagaagagttggctgtgtgcagccaaaaggctgtttcggtctggggcaccggactgtccggtggtgcaccggacagtgtccggtgcgccaggctgcctcgacttgaagacgccgctctcgggaatttgccgacggcgtacggctaaaattcaccggactgtccggtgtgcaccggactgtccggtgagccaacggtcggccgagccaacggtcggccgcggaatctgcgcgcgacacgtggtctggccaacggtcggaaagtggcaccggactgtccggtgtgcaccggactgtccggtgcgccagatctgcaacggtcggcaacggtcggctgcgcctgttaaggaaagaaatcgggcaccggacagtgtccggtgtgcaccggactgtccggtgcgcccgacgacagaaggcaaggatggccttccagatttgttctcaacggctcctagctgccttggggctataaaagggacccctaggcgcatggaggagataaccaagcattccttgagcactcttgatcactcacacatcaatcttgcgcacttgttcgacattctagtgatttgagctccgttctagtgtgctagtctcttgagctcaagtctgggtcttgtgtgtgcgtatttgctgtgatctttgtgtcgtgtgtgagttgctaatccctcccttgctccgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgatttcttgtggttattgtgttttgactcctctctagccacttggccataattgtgctaacacttaacaagtttttgtggcttaagttttgaagttttacaggatcacctattcaccccccccctctaggtgctctcaattggtatcagagccgttctcttcaagaaagggactaaccgcccgaagag

SEQ ID NO: 12163 - DNA, 223 bp, Zea mays
cctggtcacagcttctccacgctcgctcggggctgctttgtccccgtcttcctgtctgcaacccgtgtgcacaaccgcggcctgctgggtcatgggcttctccttcccattctggcgcgcccgcgcggatggctgacaaagcagccggcgctggaggctgaccgtcccgtccgccgccggtgcatccacattttccttatcgctctctcgctccctcaggacg

SEQ ID NO: 12164 - DNA, 77 bp, Zea mays
gattttaaaagcagcagacagaagagccttaactctcttcttccccaccggaaaccaccacccacctcccctcctcg

SEQ ID NO: 12165 - DNA, 1500 bp, Zea mays
ctggtgaattataaaattaaattttcaagaccttactattcatccgtacaggtgtctgatacacacatgcacggtccgatgggccaggccgcccagcgcccaagtcttagcccccatcggaccggtctrgtggagcccagaccagcacaacttaggcttgtccctcaatattttttggttatttttggaaggttttctacgacttaaacaaatatagttagcacatattccaattaactaagtgaggaaaactcacctctttgccatagtttctgcaggatttgcaatatggccaaaacaaaattcaaaatgcattttttgctacacaaagagttagagcccaatagcgagtgctagaaacattgtaatggacctatgcaacatgtctaagcgtgcaaacctcatagatttatcatttcgttccaagttgcatttctgacctcctatttagctcaacctaagtccaaattgcacatttctcacatgattgagttagagatcaaagtaaagtgctagaaacatagtattaggcatatgcaacttattcaaacactcaaacctcattttcttactattttaccacaagttgtactttgtagcctctattttagctcaatggacttagtgccttcaattaaacctatgctcgtactcatattaatgaggtgtttggtttgagaaataagctagtccatcttctcactccccactttttgtttggtttgtggaatgaaatgagttgatccatcaccaccccattccttataattagttagtactaatatgaggaatgcggtcattccattaaatttgaagaatagactcatgatgcaccacctcatcttgaatgtagtgattcctcaaaccaaacactccctaaacttattagtctaaagtggtgtgttgaacatttaatcaccaaaacagataaaaatgactatctagcacattttcgtttcaatgctgaatgtctaatcacgccgatgtctaggtggggcgatgatgaaatagaagttgtctgccatggttagggagaagaaatgagagaggcacaaagcttgattatgagttagacgaagtgttgacaaccgaaaattatattctattctatttttcattttattaaacaaccaaatggtattataacgtatggatcaagttttatgatggtattccagaaagctcactcgatagatagcaaagttacaaaactcaacttttatagtgacataattccaaatttcttagaactcgttcacaaccaagaataacgaaaaagattgagggaccaaaattctttactattaaaattaaataataaaagtttttgtccttcaattccctccattacatttcccaaacaaagtctctgccccctcgagtattttctgattgagcaatgcaccccgttccgccttcataccttgctcgtcagcccggataagataacgcccatctgcacgggccacgcgaagcgttcgagctcctcccacggcagcc

SEQ ID NO: 12166 - DNA, 488 bp, Zea mays
ggttcaaatttagaattgcattcttttgggagccgcggcagtactatcatgaccactttatttcttatgtttggtccacttttctcggctaagtttctcttgcgcacttagattatgcaaaatatcgtcctcatggcacttaaattatgctcatctatagtgttacaaatggggaaaaatgttatgttcatcatgttacgagtgcttccaaattattagttacattgttgctagaaggtggagttgctttatgcttcaagttgccaatcgggttccacaattaaattgttctattgcgtttgtggtgtcaggaccaggattagtgtgcggctatttgccttgcttctttcgaccgttttatttttttgtcacacaagcactatcaactgagcctctccgagatgcaagtttgtggtactggtggcacttatatggtatgtcgttcaatgcatgcaggtaatcatgcatcttctgttcagggcagtgtt

SEQ ID NO: 12167 - DNA, 598 bp, Zea mays
gccatttggacggtcccaacatgaagatggtgacctgaaacttgaaaacagaaggtgatgataatttcagaacagaattgcattaccaaaattacgttctgcgcgcagcaaagcagatttttttgggcgctaggtcaatggacagacagctgacagcattcagcgatggcgacccttcctcacttgtctgctctacccgatctcgatgtctccaagccgggcgacccatcagatatcgctgccttgcctgtcctctaaagagacaaacaggaggctgtgccagaatcggccgtaacagaaagggtgtgcgattggaccgagccttttcctcccggagagccattcctttccagtgcgcaggtgtgtcggtctcttgtctcaccaaaccggcgacatggtacatggaggccagcccgtcgcttggcgccacaagtctcggtgccgtccgtccgacaagcggcgccagcgcacgctggctgctcgtgcacgcctctaaatacggccccggacccgccaccaagcgaaggccaatcccgtccgccgccccccaccaaccacgaaccacgcaagcgaacccggccggcgcggggcagcggcg

SEQ ID NO: 12168 - DNA, 595 bp, Zea mays
aagttgaataaatgttcatttgccaggcctcagttatcctatctcggtcatgtcatttcagcggccggagtagctacagacccaagcaagattcaggctgtttctcagtggtcttctcccaggactgtgaaggaattacgcagttttttgggtttggcagggtatacccgtcgcttggttcgtccatttgggtcttttggctcgacctctgagggttctactaaaaaagggtgctatatttgtatggactcccgcacacgaagcttcctttgcagccttgaaacaagctttagtgtctgctcctgttttggcattaccaaacttttcattgcccttctgtttagaaacagatgccagcaatcatggggtcggagcggtgttgttgcagtccggtcacccaattgcgtatcttagcaaggcgttgggacccagatcacaagggttgtcgacttatgaaaaggaatttttggccattttgattgctgtcgaccattggcgccattacttgcaacttaaggaattcatcatatatacggatcatcgcagtcttgctcagttggatgaacagcggttgcacacaccatggcaaaagaaa

SEQ ID NO: 12169 - DNA, 1240 bp, Zea mays
cagcgactaaattccactttggtggcgctccacaataggtggtagtgatttcctccctgtcctagtggacacagtcatccactaactacacgcaggtgatcttttgaatttgtctctgaatacttaaggatagtttaattggcactcaagagtgctatcttacatgaaactgatgagagctcctcaaccttaacaacatcgtatcaggagctgatttaagcaggtgaagcgccatcctgctttacacttcaaaattagcaagtgcaatcctctggataagcatgagctagtggctgaacaggaaggccacattgctctagctccacattgtgaaaaggagttgctctataggtggaaagtgttcgtttagctttatgtaaaggcaacttttcctcctaatgcttattagtagattcagttccatatcacttattgaatatcatttactgataaacaacaattaatgaggcttaagcaccaggttaataaggagcttgtatatgtacataatagctgaagatttgttaatatatttgctatactggaggaactgaaagcagaaaagtcaatgaataagaatcaaatacatttcctatgctgtaaatgaggcagtcagtagttttactagtatatatgccatcagaactggaacgggatagcagctccttattagtagtgcttgcagacgtacgtccaacgcatcgtgcattaggttatgcgatgttctcttgagtaaaatacttccggataacattaggtcaggaagtggacggggaatttatatggaggagaggaatatatttcgaattgacatctgctgaggcaataacagcactggtgtgagttccacaaatgagcacttcaaacagtaaactttggtggcctggttcctcgtgttgctatatagctggaaaccccccagtgttcgttgtgtggatttgtttgctttattaaagcggagttaattctcgttaaaaaacagtaaactttggcccagcttttattgtcctttctccactaaaacatggtgcgctcgccaatatgaaaagccaccatgcagattcccagttcttgcattatatatagcgctggacaagtatcacctgcagacatcatcgtcctcaccagggtacagacgtgctcctccttctcccctccccttgtccacagcccccgtagaccatggaagatgcatggcttgagcatctgcatggttcttgagagttaaagctgcacgacg

SEQ ID NO: 12170 - DNA, 243 bp, Zea mays
tacacggctgccgggtctctctctctttctctataaagcacggtgcatcgctcgggggatggccacctccgaatttactgatccatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacaccc

SEQ ID NO: 12171 - DNA, 1500 bp, Zea mays
ctctttgtggaagcaagcaaattctaggctggggttaaaaaaatactctcgtttgtcccacgctagagcacaatcctaaggcccgactccggtcgcaatcgttcttacatgggctacggtgccgctatgtatgggtagcgcaggagttcaacggttttcttaacctatgtgagaatgtcaccttcttaatacaatgtccaaggttaaggtcataggtctatttgagactatgtaatgtttttcttctttattctaatgaaaatgcagctctcctatattttcgagaaaaattaatacaatgcccaagggctatcttaccccctataggtcaagtttttttggggtggaaggcttgtgccaacatcaggtgtaaccaaaatacctgaagtgtaacaccaggtctttataaactacttctgtttcaatgaatgtttcacattttgaggacaaattagtgaacaattaaaatgacacaagtacccctatgctttttattccctccatgcgttggttagaccaacttactattaaccattgcattgtcaatttgttgggctatttggttaagtagaaatgatgtggttttcaataaatcgtctcctaaatcatgtctgtatgtcactttcagggcaacttattggtgccgcttctgaacacagcttcagcctagatggtgctactacatttttcgcaatgtggagatggtgctactacatttttcgcaatttcggatgggggtcttcgttgcctttaactttgtagtagcttggatttagtagttggtgttctttggtgacgtcgtgtgatgggtcaagacaatatgctgccttcggttgtaataattggccgtaacctcatttgaagccaaggtcggacgactatgttttcgttatctaaaaaaaattagcatagacagatgcaatctataatggcacaacatcacagatataaaaaagataacatatttgaggagtgaccacaatcaaatcatgactgcacaaggcatagacagattccatttatttggtaacgagattagtagcatagagattgcagttcaaacaatttaagttttagaaaaattttgcgtcgctatgtcaggtggtctttgtggcaaatccgaaagaaaaagcggaagatgacaggaaccacgctagcaattccggaggtacaagacaactaaaagtcgaagatgacaggaaccacgctagcaattccgaaaagaaaagcgtatttttgtgtggcttgggagccagtgaaagaaagaaagaaaaggctggacagacaactccatcagcaaccaaaaaaaaaaaaaaacgtgctacgacaccagtcaatggtcaactccgacttcgactttccaagttccaacgaacgagaaaacttgcgcgccacgccgctgtgcctccacccacagcaaaggaacgccttatttatttactccagggcccaggctctgatcactacgaagtgcgaactcaaagctgaagacaacaaacc

SEQ ID NO: 12172 - DNA, 528 bp, Zea mays
cgcgagccagattaacaacacggagttaattaactgacgtggttttaggaatagctgttgaagtttaaaaaattgttagataataattaacttaaatcaggtcctattttatttttaggccttaattataggagtcccttttgagatgctctaacgtgatgtcatagggtgattgtcttctgttctgtctggcagtttttttttttttgagaatccgattagcgatcaaggctagaattgattattgctcgcgggcgacaagtgtggtgacgcgtctcgatccgcgcaccgcttgggcttctcgtaggagtactgctcagcctgtcaccgtcagcgtatgttcttgttccagttcctatttttactccaagtccactagggatcctatccagattcgtggggacaccctcttcgagttccaggcttccaaggtccaaccttctcctctgaggccgtagcatttgtctggttggattgggttgttccgcttgggtagccgggtgggatcgaaatctgtgtggcacccat

SEQ ID NO: 12173 - DNA, 278 bp, Zea mays
ggtgatgttgggttgctaaaccataggcgcctgattctggctttatttccagacgacaaacaccatccatctggctaaggggtgtttgggagtgaagttttttcacagttttagaaaaatactgcagtattatatacggaatggtgtttgacaagctggctaaaatctctgtttttaaaactgaagtattgtaaatactatagttgttttaaggtattctaaacttaggtctggacctcagttttcaaaattgtggtattgtaaactgcggtattgtc

SEQ ID NO: 12174 - DNA, 659 bp, Zea mays
tataattattgttaatttttataatgacatcatttagcatataatatactctaaatgtggttttcaaattatcgtttttaaaataaattgaataggataagcctgtcaaatatagtaaaaatgtcaaacaaattataatttaggacggaggaagtaatagagagtaaaaaatatattctccaataattatttttagttaataactatttcaaacgtgctaatgtttgaatttagcctgtgacgcgtaaggccatgttcgtttgatcctaaaaccataaggattgagggggattggatgggattggagaggattttgacttgtaggggatttaatccctttcaattcatatggattggcacaaaacgaacaaagccttaacgggcctctgctgggttgaatccgcgcctcgtacaaaaatgggtttgagagaatgccccctcgtctatataaacccaacctcgaagattcgtctctcccgaaaccctagctcacttaacgccgccgcggagctgctccgcgcccccgacgccggtaagaaacaagagagaacatctgtccctcgtcttcttcctgacgcgatcgttcatcgctcgattttttttttggaaccgatggtggaaccacaggtgattaggagcaggagcaagaggggttcgga

SEQ ID NO: 12175 - DNA, 226 bp, Zea mays
gaggataatcgttaggcatggttagagataccacagctgggcaggagaattttacacaaaatacttgcaccatatcgccagtgaaaactcggtctgtcaaattggttgggttggtcgaagaaaggttaaaaattcttttgtggcgccatgtgtcgtgacgcattgcgctttgcatgcaaattggttgggttggtcgaagaaaggttaaaaattcttttgtggcgcc

SEQ ID NO: 12176 - DNA, 218 bp, Zea mays
agtagagcacgctacacttcttggaatctattgcatttgcagtcggtctgacagtctctcctaattgatgtgttcatctgtcgttgtgtgtgtgtggtcatggtgatggagcagcgttcccgcgggcgaccaacgcgtccctctccttctgcggctacaacggcacctcctgctgcaacgccacggacgacgccgccgtccagaagcagttcgcggcc

SEQ ID NO: 12177 - DNA, 158 bp, Zea mays
tttcgcttctcctctgcgcgcgcgctgctgtcagttagctgcctctgctctccggccgggctcgacgatccaacaagaaaccgagcgagcgatgtcagcagaggaagagccgaagaagaagatcgacttgctggttggcttggcagtcctggagaagg

SEQ ID NO: 12178 - DNA, 550 bp, Zea mays
attattttatttaactgtgttaatcaggatataaaatcaagacctctggcttgttatcatattgagttgaatgcaccaaggttttaaagtcggctagtcgcctaagcaccgataaggtgactaatagcgattagtcgagcctagtcgactcctagtcgtcctataatcgtccacctataacaggaccttatgtataaatatatattaatatatatagttgtagcagtactgcaatacatcagtacactatagctgtagcaggacaacaatatattatagctgtagcaggacaacaatatattatagctgtagcagaacaacgggaaaatatcctatgcaatcacttatcctgtgcaagcatgcaatcaagcgatctggtgcatccgatctagatctaatgatgactgttattttatatttaaccccttccacctaaaacatagtacctattttacttttaaccccttccatatgaaactattgaatctggattggatgctctggatagtttgattgcacgcttgcaccaaaatgagtgattgcacaggat

SEQ ID NO: 12179 - DNA, 1500 bp, Zea mays
aaccaaccaaccaacatacatgcgaaacactaccgctcaggtttcgacccggaaagcgtcggaaacttcgcgtcgcgtacgtcgttggtccaactcccgcggcgcgcgtcggtgaggtcgcggcagcggcgtttcaaagcttgaactgttcttgcgacttgcgagcgcagtcacctgagctgacggaagaggagtaggaatacccttggccgggtcccggttcagactctgaagctttcagtttcagtacgccgttgagcgttgacaactgatactgtttctgtatgtgcgcttgcgcgtcggcgaattgacatgtctgtacgttaccgggtgaggggcgacaggcagtgacgccgacgcctcgccgtttcagcgtgtgcaattgcgaagtttttttctttttctttttataagcgacagggagaaaaaaccgcggcgaagctgctgcaactatccccgtcgctcgcatcgttcgatgcaagctcagaattcactatcctcgaacgcgccagcgtgctgggttcgaaaacagaaggcacggtaggcgacgacatgagtggtccacgaaccgtacgtatttgttgcagcaaggttaaaatgccaagttacccgaggatcggacagggtagatgcaccggaaacgggaaacgtctccactagatagggtaaaataggggatgtaatatggttcggaaaatatatgtccggatctgaatttgaagatggtgaacatcggttcgaatgtaaacaccatggaaatcaaggcccgccctggaaatcggaaatgtaaacaccatgggcgctcagccactgcatcgcactcgcacatgatgccgaattgacaggtcgggcatttttagcagcgtacggtcgccgggctgatcttgactcctgcgctcggaggattgtggcccgaagttctgacacagccgctggactcctcgatccgatgctgtcacagctatctatcacagccaccgggatccgggagtcgcttcccggcgtgcaatgattccacccacctggccggggactccgccaacacacgagcacgggcacgaggccacgactcccaaacggaaacgcgcgagttattacgctttacgcgcggacacggctgcccagccccagccgcccgtgaggccgcgtgacgcgaaacgttccttcctcgcgcggcttaaagcgtttcctctctttcccctcgcagatctcacccaccgtctacctctcagtttcgatcgccgtcgagctccaccacgcttaattgtccccatcagggcgggagcgggggcgggggcgacgggcccagctacctaccggttccttcctctgaatcggccaatcggccgcagctgttcttggcccagctgctctgctcttgtcgagggatggtccagtactcctccaacaaggctccccgccgacattaagctactgtgccttagttagcgctgccgattcggggttgcttgctctctgggccgtgcccgctgtcctccc

SEQ ID NO: 12180 - DNA, 1250 bp, Zea mays
ttatataatatgaaagcatgtagattgccatagaatagaaatgatgaatatgcaatctaccatatgagaggaatttctccaaagaatggtgacataattataaagacatttaaagtgcttctttttctatgtgactacacaagacaccatgagaaatcataatttaagatgcttgcacttaaaaacataagtgttaccatcctttggctttcctccatgttgtaggccttgatttttccgcatagaataattctttatttcctacaacatcaatatcttccccgagatgatatgagttctagacatgataatttgaaataaccttgggtcaatcttgaatatgtagatcattgaagattgatagcttgagttaataagaattgaattgactctctcaagcaccccaaagcttcatatcatctccttctcctgcaaagcttgtcaagcatattttggtaccatcgcttgatgggtccatcaaggttagtcaacaaagatctaggaatccaaatgtcctttgtgttagcactaggtaaactcattacctttctagcacaagtcgcaattttgggttgcctagatacatgagaattaattgacaagctaggagtgggattgttaccaatgggacaatccttgcattgatgtcccttctttcggcatatgtagcataggcgatcttcaagccctgaagatttcttccttccttgtttcttgcttgctagatggttagtgagtattttcttttctaaccctatgccttttcgtttcaaatagggacaagacttaattaagtgtcccttccttgagcatttaaaacaaagtttatcatccttgttaataatcaagtcatttttaatatagggacatgacctaatcgagtgtcccttttcaaagcattcactacacttcttatttctcttagtgtgaagtgtggcttgatcattaccttggatgttaccttttatggaggcgtggttgaggcttttgtgttagaaatatgccctagagataatcatagagatgagcatatttctttgtatccatgatatatatattgcttaattgaatatccatggaaggcaccttgtattgattagcaattatgtgaattgtttgtgagattctttacttatatggttattctaaatgatgtccctagtcagagtcgatgactagcacatgtattagttgatgactacatttcacaagtcatgaacatggagatgttaaactaataatgtgggcgc

SEQ ID NO: 12181 - DNA, 229 bp, Zea mays
atacgttttctggttaatcgggtccttcggcttgagatgttttttgctttcctggcgagatttttctaatagttgcatctagcaactgcttttaatattctgggttgttgtatttaagctgatgttcagaatgtctgtctaagcaggagggtagatcgtgggtctctctagtatccagtgtttaacatcaacgctacttttccattgatcactactgtttgatcctaca

SEQ ID NO: 12182 - DNA, 1286 bp, Zea mays
ctacgtgcaaatattctactgtacttgatttatttggagatcgcagcaaggcatccattccagtatcaaaaacaagttcgttaacttaaaacaaagaacagcgagctccgcgtgacgcttgtgcggctttacttgcgtccccctttaatttttttttatatatagttggggtctcttttcagaacggttgctgttcaattagcatgtgttagtcatgcgggcagaatcaaaagttggtgttagtgcggcatattaattatattgcttagatgaatatactttgcttgcgccaagacgaatgctacgtcgtcgtcagagcgaactaactgtccatgaatgaatgacatatagactaactgtccatgaatgaatgataaaattatttctgttttttttctcgaacaattttgaaaacatttttttccattcttgcattgttccagcgcgagatacagatcggtatggattaaagcgttactttcttcgtaatttggaaattgaactcgtcttgaaccaggattcacatgcattgccttttccatccagattcaatgcacaacgcccgaaaaatgtcgagaagaagcgacgactgcaatttgtgtaaaacatgcatggtgcacgtacgcaaatgagcgcatgtggatttcacttgtctcgccgattgaatcaaattaaagattaggcggcagccccatccacaccattttatttttttgaaaccgcgtacacgtctagaataaatacagccaaaaatatattgctacactgctacatgtaggatctattatcacgttcttagccgtgtcacgtcgttagctatgagatatcgctacagtgattagctagctaggtacaagagtcgtagagcggtagaggagaagcgtcgacgtacgccatcgtcacatgcatgcgtagcagagcacaggaagccgccaggaaggaaccctgctacgtacacgtacgtgtctacagctgcccatgcccgcatcgatacggataggtgcgcatttaatacaccaccaccacaacaaaaatacgacccgtatatgcatgggcatggcgcggacgccgacgcatggcgggtcaaacgcacgacgccgccgacgcgcgctatatatccgtcgcactgcttaccctacgctacgtcgtgtccgtgtgtgccgtgtccgtgtgcgcgactagctagctagtgctgtgcacagtgtactcatctcgatctacatatcgtgtccacgcacgcaggaggagagcgggcggtccacgacgacgtgcagcgcgcggcggcc

SEQ ID NO: 12183 - DNA, 1500 bp, Zea mays
accgaataccaaacttataatcaagataatacatacaacaagtttacaagcatggcgagcggacctgtgtggcgagctgcggcatctggggaggccttggcagtcgcgccattggagcccaagtgggggctatgcgccataacacacgcgtgtaatgttggctctctgtagggctgggcattcggtttttttctaaacttcggttcggtttttcggttttaaaaaacttcggttattcaaacattagaaaccgatcggttttctagaaaatgaaaaaccgagaagttcggtttcggttttttacttcggtttttcggtaaaaaccgaataccaaacttataatcaagataatacatacaacaagtttacaagcatggcgagcggacctgtgtggcgagcggcggcatctggggaggccttggcagtcgcgccattggagcccaagtgggggctatgcgccataacacacgcgtgtaatgttggctctctgtagggctgggcattcggttttttttctaaacttcggttcggtttttcggttttaaaaaacttcggtttttcaaacattagaaaccgatcggttttctagaaaatgaaaaaccaagaaattcggtttcggtttttttacttcggtttttcggtaaaaaccaaacaccaaacttatactcaagacaacacatacaacaagtttacataatatattacacacaattttaaaaagtaaaaattatataggtacaaaaattacccatgagggtaccaatatgagtataatttcatatcagttttttaacggttataattttatgtcgtgggtatgggtaagcattaccatgcggactttacctatcagatattttattcttaaatcggaaaaaaatacaggttatatctaaaaaaattacaacaaatcaaatatgcaattttagcattgaatatatgcagccatcgtttcctgaaagaaaaataaaattcaccagaatttagtaactccttttgtcgtctaataataaaatcccggcaaatctctagtggcctttctataaaaaaggaaaatagagcaggccacttaaatttggcctcaactacggcgcgttccctgcttggctttggtttgccaactttggcttgctccccagcacgaccacgcccaccgtcgacggtggcagacaatcgtgcgcgcgcctgtgccggtccgggggggagggctggccatgcacgcgcgcacaaggcacgcacagcaacacaaaagttccaaggcctccccttcctctagcagtggcgaggcaggaaggcaggccgggtgtcctgcctcccttgcgcgcgctctcacgacccatcccgtcgtgcgtcatcgagctccggcgggcgggccatgcacgcgtccagctagctcacacagcgccgtctcgacctgctgccggtgctccacccggcccgcgtcaacatcacggcgggcgggcgcgcgcgtgaacggtttcctctccgcatgaccctgtg

SEQ ID NO: 12184 - DNA, 1484 bp, Zea mays
tctttgaccatagaaatttggaagattgtcaataccctcgtcgagaatgacagtgctatcaatgtagaactaccatatatatgcacctcacatctctttcttttattatgagcttctaaatcgttgttggacgaggaaatgaaactttgatatgtggtagttctaaataattgaactttaaaatatgaactgctcattgtttagtgttagtaattttcaacggtttaataattactctaaaaaattaaaactttaaatatataaaacacccattggtggactaaaacaatctaattaaattctataatcacactttgtccgtcggaaataactaacactaaggtgctgtttggttgggtgtaaggagtggtaacgacaatggaatcagcagccggtgttatccggtgcagagtaatgattactgccctttgtttggttattgtgggcagcgttttctgtttttatggtattggatgacgataggtggggagtgggaatgagattctacaggcttatatctgataacgctgttatcaattacggagtacactaaccaaactctaaggaacggtatcagctatcccagggaatggttacgggtctaaaatggctgaaccaaacagctcctaaatcatattggtggacgatgcgggcgcatggacgatgcgggcgctcggtggcgggcatgggcgctggcgcaatagagggggcgcgggcgggcgacgggtgcgcatggtgaaacgacgcgacggcttgttgagtggctcgatataggccggcgtcagtcgtcaacagagaaagcgagttgaagaaaacgcgcgtgaggccgggaggaatgcgaatggtgttggctcgtccatttcctaacttatcctatttctgaaggcttaaacaaagaccgtcagaaattatccgatggttatcagactaaaccatcggacataatataatttctgagggctttgtctgacagtcattggaaattatattatttttgacagccactatagtccgtcaaaaattacattacttttgacggtctcaaggacagccgctcgaaataattgtggtcgtcggatttgctgtagttctatgttgtgctcccttgcaattgcaaatcactcttgtaactctctgagaacaaaacatgtttgaccaaagcggtttgtgcatatgagccggcaacgcattactttagccaccgccttcttataaagagaagaagggaaccaatggtcgtcatgcatgtccttgtcgaacctttcgggaataatcggatcccaagacctttttgtattgtgcctgtgttttacgacaatgagccaatgattcaggcgaaaacgacgggtcaagaatgctgttgttaattattcacgctccatttctcccagcccgcggctggctataaatagaggaatgcgtcggccactgagccgcaaaccaagactgctacgacctctcatatatattatcagagcttagcc

SEQ ID NO: 12185 - DNA, 91 bp, Zea mays
ttgatcttgtgccctgggaccaaaatttgacaatgcgacagcatttttagtatttgaaaggttttgtaataagcaggtcatcataaaccct

SEQ ID NO: 12186 - DNA, 135 bp, Zea mays
ggtggagctgcaggcgccggcgcgccgccgcccgccctgctggtgtactccgccgccgggacgaagctggcgggcgccgcggcggagtgcgccatctgcctcgccgagttcgcggacggggacgccgtgcgcgtc

SEQ ID NO: 12187 - DNA, 1500 bp, Zea mays
agtgcttcgaaggacaaaggtgcttaatgtttaacatttgtgttgccttgtttttggttcacagcaatcaaaaacaagtaaacaacatgagtcatacttcatctggcagcatgatgactgtcgtcagacccttgcccgtgcatctgctcggtcctaactgttcagcgtctgatgttcacaaagcacaagcgatggctgctctgtttcgtgcatgctccacacacatgcgtcgcatagcatggagagctagttttgggggctccagctcccagctagcatgcaaaccagctctagctcccaactcaggccttgttcggttattcatattatacatggattgaacggaattggaattttttttgaagaactttgacttgcttgggatttaaactcacccaatcccactcaatccacatggattgagagctaaccgaacaagccctcaatgttgtttttggagcctcgtttggaagggctccgacaaggagccagccggagccgcccgggagctctcccaaatgggtactgagattcagctcggactcccaatcatatggcgcgcagttgctccctgtcgtcccatgcacaccatggagtcagagaactccatgatgtgtactataagagcccatggtggcaatatgtcgagtagcgatttgaatcatgggccttggaatctcatgggctcaaatatgactagtagttattggtaccacaccgctcttttttattttatttcgacatgacaatgacaagatactaagacatggactggtgtgatgaatgyagcattctggtgtaaataaaatacgagacataggaaaaaaaacaccttgcacggcaggtccagttaccatctagagatcatataaagtagacagaggtaatggctgatcgcaaaggtggcctaggtgtcattgtattcctaacgaaacattttgagtgaccctaccaaccctccattcaaatgtttatatttattctatgtttaactgttatagtagtcatctaatgtacatgaatatctaataccgtcaacgcaccgcagatgccgacattggcaccgaccttgtgtagatgaattgggtggtgatgccgccgatggaggcatagtgtccagacttcactttgacgctagctccactactgtgcaaaaggagaagaatatgtgcggaagctatctttaggactcatcgtctcattaatcggcgccattaatggcgttaatggccggscgaccatctccctcctccggcgccccttcccctcttcctttataaaaaccggccgaccggacctctctcccctcccctcgccccatgggcggacccacagggtggtccgggtgggccctggcacaccctaagccaggtccaccgggaccccacccggtcattcggttcggcggacgtccgactgctgttccaacttccatctccgaatctccgatcgttcggcttcccacagccccaaaacgatcgatcctcctgcgcaagacgg

SEQ ID NO: 12188 - DNA, 1500 bp, Zea mays
aacatgtgctattaggtcgttatatatgtgcacaaattatatgcagcgggctgagtatatataattatacataccatacaaatataatcattatatgacttaaaaggctactgataatagatgtcaatgttcagttcttggaagatttttcttctttgatgctcaggggtccttattagatgtgctatatattttcacgtatagggtgaccggtgcttgtatctttctattcacagatggagtatagtataggaacgcacatggagaagtttaatcaaattcataagcaaaagcttccatccttgtcacttaattttatctaacgctatctgataagcagaacctttcacctttcccatttgattctattcaacgctatttaaaaaatgtcgtccgtgaacttcacggatgttaacaattgtcgtatatatattattggtaagtcttattaggtgtacatttgtagacgttttcaagggtgaaaataatttgttcacaactttagaacccaaagatctatcatgcataccttctagcgctaagattatcaagatactgagaaagcaaacaaattggcaggaaaatcttaacatgtgaattawagggagaccttcatattaacataataaagtagtacttatcataggcagcatgcatttttttgtctttctttattctgttcgattcattcttatttatcaactatttgtgagacaattcatgtccataacgatgttgctccgatatcctctaacctttgacaactatctgcagattgcagcatctcatgtggatccactgcacttgaaatacttcacttttgcgagaagaatgattggattagcattgatgcataaagtgtaagttggagttgtggtaggtcgtactctgttcttgcatcttgctaggagaaatattacattgaaagatatttcggttgcagatactgtcaaatatgcaagctgtaaaaagattctagacaaggatgttgttgaaaattgataatctatacctggtattttgccgaggtgctcatgagttaggtactgtaaaggttattattgatctttggccaggaggacaaaatatcagtgtgaataatcctagcctcacgtgagcaattcagcaaacatacacccagactgtgaacgaaaaagtaaggctccagcgttcgcgtctgtgccccagtcttccgtgtggccaaactaactaagcaaccatcatagcgcacccctatccagattcagaacataataggaagcatgaaatcgagatctgcagaccaaaggcacagaacagaacaattactcaccatagtgctacgtttgggcaacctggtggcgagctcctggacgacctagtcgccaccgcagcccaggcgtaccgacggcttgacggagaacgccacctatatatggtgcgactgcatgctctcagcatctccaatgtcagggactgcctcatggctggccggcgttagcttctttgtgagcttattcg

SEQ ID NO: 12189 - DNA, 645 bp, Zea mays
tacctgccgatccatacggctgcacctgccgttatcctttgacctgtctgccgacagagatgagagaatctgcaactgcagaagtgcaaaacagcctctgtatcggaacaaacccagctactttcagctacgtagtacatcgcacaactactgcgagtctgcaaagcacgtacagtactggaacacgtctgttgcagattaaagctcccgttgactgtgacctgggcaggtgctcgtgctcgatcgaccgcacgcaccgaacctagcacagccatgcatacgctgccaagcagaattgcagttgcggagtgtcttttgatcggcgcacatgcatctgcatgcatgccgcctgccatctctgaaaacgacgcggcgacggaaacgttgccaggaaacgctcgctcgtcgacccgaatgaatgggaatggtatgattgctcatccttcagatccaagaaaaggcgcgcgctccctgtgctcaaccacctcacgaactccgtggctataagactcgccgggccataacactgaactgatcgagtcacatgctagcgtgcgtgtgcaacggctaccacctgcgcgaaccaccgcgagcgcccgcagctaagctagctctcgctcgcgcgctctgggagaggagagatca

SEQ ID NO: 12190 - DNA, 822 bp, Zea mays
gcctctctttttatagaggaggggggctggaccctttacacgaccggattccgagctaattccgcggatatagctaacaaacatagcacaaaactcggaacgctaatctactctgcgcgtgcgcggaccgtccggcctcagggccggaccgtccgcacctcattttggtgctcaacaacaccacatatttgatttcgcgtccgaaaatccggatgtgacatgcacgcactcttggatcaattctgcagcaacaatacacttgcttaatcccaacaatataaattgcaagaaattgcagacgttcaaaagagagaaaaaaactattacccttgtggaacatcagcaagatctatacaacttaattctggattgattcttgatcactaaaagagagatgaactagaaccatgaaactaacaaaggaagaagggaaaagatggagatacataggggtcgccgatagagaacgtgtgtggatgagggctctgggcggggtggaggcagccgccactgccagagagatgtgcaggcggcggggaggctgccaggagaagcctcgatcctggagaaactgaaaaggacagaacgggtagaggaattgactgcttgacaaaagaatgcccttgtccgacggaagcaaacagaatgctatgtatcggtatcgttgcatttttgaatgataaatatttagagttattccttttgatagtaaatatccaaagatggggtctttaatggcatggatctttccctttaaaaaatatatccgaacataccctaaaagcagagccgtctgcgttgccgctaacaaggccgccgccg

SEQ ID NO: 12191 - DNA, 747 bp, Zea mays
ccagcccctgcctagccttctcccctactactgctagtttttgcggccatggttagactgacrtcacgcgcgaatagctgatgcatgttacttgggctcttagtttagttttctgggtaccttcaatagatcaggataggtgctttggtttctttaacaaagaggcaaatcaccagagttaatggctctactagtcatcaagaatcaagatataatatagattaaatcagtaaccactcaatcaaataatttggataggctggtggacttgatttcttgaattttgggccacctaagtcattttattttagaaaattgtgttagctctcattttcccaattaaaggcctcaactgaatcagactgatagtatgtcagttgtataagctagaagatcttgttcttggcagtttgggaccacagtccagttgcatgatgtacacgatggtggtagcatgatagcctaagagcagctccaaaagaccttgtatctgaccgctaaattttagtttagaaacaaactcgtggaaaaccatctccaacaggtgctcaaaatgttcccaaaatttccgtgagcatgtgatcccctccaccacgtatattttcgacttttcgtggagtgccaacgcccccattctccgtcaaaatctattcttgtgcgtgattgtttttcccgcctttcccgtcactatcagcagcggcagctcttcgcaaacgccaccaccctggccatgtccaccagtaaagc

SEQ ID NO: 12192 - DNA, 208 bp, Zea mays
ggccaccagtcctaatcctcgaaaatatctcacgattctgacaaatatccgaacagccaggcgcgagccgttcaccttctcgtggggtggggggtatttattaagcccctcctcactccccaagtcctcccgtgycatcgccattcacctccagccaggctccggaaccttatcaccaaatcctcgtcccctacccgagrcgagcatc

SEQ ID NO: 12193 - DNA, 345 bp, Zea mays
gcatgtttttgtttcagtcatgtataaatgtttatgttgttgcttattaactactactactgcataaaatatatatttttctgagtaaatattgttttagattaacagtctgttggtttgcataaatgtatatggcaatttctataatgcaatgatacaattttttgatgtttgactatgttgacatttattttcttagggtcatataacacaattaatgaattataatgtgtatgactgtgttgagtgtttaattagttcatataatcattggtgtatatgtcgatgtaactcaataaagcacatatgttttacattgttcttttgcaggctgctgcttcaata

SEQ ID NO: 12194 - DNA, 882 bp, Zea mays
ccgaaggcccccaacatagtccctaaaaactaaacattcctaaaacagagctgtgctaaatggtactccctccgtttcttttacactatccagcgacaaataaaaagaaacggagggagtactacctaagatagatttgcataaaccgatatgacaaacaaaaatggaatctcctccacctcccacttctgtcggcccttgctggtgggtgaacccggcgtggcactggaagcacggcatcctcctgcgggccgttttccatgccgcagcgacgagtcggcgggtgaaatgggagaggagccaagccaaccaaccaagtcctaacgtagcgcaatcatacgctgttcttggtcagacagatcaacccagtgtgtatgtaatgtaatgcaaggaaaagagaagattcgctgagtaatctggttgatgaaaacgtccgttccgtcggccgttgttggttctcgttgaagtgttcaagctcataatcataacggtcaggtaaaacaccacatgcctgcgaagagtcaacgcagtcgcaggatgacttgtctctgcctcctgccgcaaggaagcagccgctagctatgcttggtagccgcgagcgaggccgaggccgtccgtggccacaaacccggaggaacgaggacggaggcccgcttttccacgacggcactgtggcgtgccgctgtcaggcggagcataccgccgtgcggtgcagatccgggccacgtccttccgccgcgccggtcaaacagggctgctgcgggcgctcgcggctttataaagagcagaaaccttctgtaacccaaactcagcatccagactagagtactcccggtgccatctcctccatctccctattcctcctcagctcctggaccagac

SEQ ID NO: 12195 - DNA, 867 bp, Zea mays
ttctgttgaacaacaaccaatccatcgaagatcacttgtattagtgcaacactttcaaacatcgaaacccatccgaccaccatttgccaccatcaacttccaagattcatcaaacccgctaaaatcatagcaatttgaggaatctagaagggagctgtatcagctatgccaatgtgatgtcattgctcggacgccgcttggacggggaaggaggactgggccaagattgtttatgacagccaagactagggtatttgactatttggtttttttactaaaaattagtattatcacatccaacgtttaaatactaatttacgggtattatatagtctaattaatctatgattagcaaatatttattgtagcatcacatgaacaaaaaccgataaaacttgctgtttttggtccggtccgagataaaaaaaccggtccgattttttttggtgtattttagtttagaattggaaaatataaaagttaactttggtcaacaaaatggttctccgaacttctaaaacgaaaatataatccttaggctacaaaatctgccacgaaatctcctaattatttttgtttgactcatttacccttaaaatctcacgtcgctatcagattgtctccagcatctaccgtaccaattctctattttacccgtggacacccaaacacgcagaggggactggggagatccctcctcactctcactttacccttctgccattttccaacacacgctatattataaaacatacccaaagagatcgtcgcctcgatttctcttcgagtgccaagcagtactgctagttctacttctgtacttcagcagtaggaggccgctgtttgctacgattttgactgactgag

SEQ ID NO: 12196 - DNA, 633 bp, Zea mays
tggccacgagcaggggggcgccaagagatggcgcgccggaagacgccgggggcgaccagcgctaagacgcctccatgctcagatgtagacgtttagaatatgacctaaataataaaatatatccataattttactactttttaaatcattttttatagtttaattgcacagcattacatgagaagtttgattccacaacggttcattcattgatttgtttgaccaattgtgtgtgcacagtacgcctgatgggcgaccatcacttcaaggcccttttagattattgcgtgttttttcccatttcttatggttttttctagtttttacaaaaatgaaataattttatttttacactcctataaaattctgtgttccatagttagccgggccacagcccacaggggccttgatgtttcaccagccaggcaaagatgcaagtgcacagatctcctttgacaaccaaaaactcacttggccggcaaccatctgtgtttttcccgcccctatttgtacgcatcaccatatcattcaaacaacacgcattggccatgccgtcaataaaccacacaggcttgcaattgcaaactgaggaggcaaggctgcagctgcagttaactgttatcgtcgctgcaa

SEQ ID NO: 12197 - DNA, 334 bp, Zea mays
cgtaagtagaatgcccaccccaacagctgtatatatttcatctccagcctagcaggccctggtctattctattgagtagtccagtcgacctgtacaatataagttatgtaacatggccaatggctgaactagaaacatacatcacagacaacaagaacatcatccccaaatttatgtcagaagaagcatgctatgcatacatggttcctgatttcccataaaatacctcctgcaggctgttgtcacaatgtttaattatcaacaatttcggcatatcggcgcacctggttggcagcttgggtggacatgggcaaagaaggaggttatatggtca

SEQ ID NO: 12198 - DNA, 1438 bp, Zea mays
ctgatcggacggtgacgaacaggttcaccgcacgaccgagggatgggatgggatgggatgggccgcgagggatggttggtggctccgggatgggccattgggccgtgtgcatggaccggggccgagggagtgccccgtgccgtgcgttgggttcctcctcgaaactcgcgtggggccgcgtggttcgaggccgcagagcgcacgggaccggtccgggccgggcgagtcagcgagtagaagtaggaccgggcgaccggcgcggctagactcgtcggtgcttttgaggcaggtgcgcctgcgcgcccatgcgctgcgtcgggtttgcgagtcttccttcttccatggccgcaggatcaggacaatagaggcgactatttttttctacgaatacagaaccgattaatttacgacgatgctaaaactacctagaatttttaaagtgtctcttatgacagtccatttacttgaaacacaaaagggtttgtaataatactataataattgacgattcaatatattttggggtgggcaaaaaacaccaaacaccaaaaaccataccgaaccaaacaccatacaccaaaatttacggtttattcggtttttgtatttggtgcggtatggattttagctctatttggtatttggtatggttttcaatatttagacaccaaaaataccaaaataccgaaacgtagcaaacctatctcttgaagcccaacaagcagttgttataaggtccttagactcatatcattataatttttaagaactatgtgttagttgctcttattcaacactaaattgtttatgcaattttattaagtacttgttgatgaattatcagtatgttctttatgcaattttatgtttgcagtttcaaactgctagttgtttggtgattgtggtaataccaaacaccgaaaccaaaaaaaaactaacaccaaattgtacgattttttatttttgaacaaaaatcttggtttacattttctaaacaccaaacattttttgacaccaaataaaccgcactgaataaaccaataaaaccgaatgtacaacactaatccaaagatagatcgcccaggagctcacgtgccccgccctgtgatcccgcgttcgttcctgctgtctccgtagtccgtaccatactccacgtccacgatgacccccaacgacaacgacgcccacgccaaccgcgtgagccgagccgccacgatagaaaacttgctcccttgtctatcggacaaacgcgcggtaaaaggcaatcccggtctcgggcgcccaatttctgtgaacaggtcaaacccccccgcggcgccccacccccgcacgcagcgagtcagcgacgccccggccccgcgtcttcgtattcataacgccagagtccagactccagagtcctcagtcctcaccggcttctcctcccttcccgtcaccg

SEQ ID NO: 12199 - DNA, 1073 bp, Zea mays
ctgcactgctgccgccaaatcaaacttccaggggctcaccgtcgtcgtcgtcgacgagaacgcgtctcatggcgcctgcaacttcaacgtgcagcttgttgggtcagcggctccggtggtctctgcggtcactacgatgacggtcgtaccggtacctctgtttattgtgttgctttgagctgacgcgagatgtggtgcctgcatgcgatgtttcaagtagtatgaaacaatgaagagctttgcctctatgcaacatttcaatttttttgaagaactggttgttgtaagaataatatttatgcaatcattttcaaggtctgtttgttggcacaaagagtttatcatggaacgttcaacattatactttcaacggcttatatgcagacattgtgtacctacaattctaagcagcaacttatacaactaacacatcggaagattatacaaacatctgaagcttatatgcagacattgtgtacctgcgattcattgtgtttttgaattatattgggggttgttggagacgattcatttttttttggaattaagacatttagggagatcccaattctaagtattaggagatttatttttggaatctcttggaaatgctcttagtggtcaagttgatcattcggacagaagctgatggtgctcccatcatcctatgtacctaccgcgcgcggcatgcatcgcatcgcgtgttgaagcaggttgattcctgatctgcaaatcccactgccgccacacgccacctgccaccgccactggtttttggctgttcccgggcaaactcgccaccaattgccacgctgggtgatgctagcttagcagcttttttgtatcttcccagttgtttgaactatatggccgctcctctcctccatgttccatgccgcctcggctgcaaggatcataaacaaacttattcactttttatccgataataaatacgaccgacggctgcatgcgtgagaagagatcaagccaccgctagtcgtcgcggtactcaagtgagatcgagccgggggattcgggatcaggccggtacggggggcgaccgaggaccgccg

SEQ ID NO: 12200 - DNA, 650 bp, Zea mays
gagcatacaagagcacaatcaggacgaagcctgaacgagattatgacgaaggtctagatgatcacgaagctgtgcgcaggaaagcttcggcatgatagcagaaaaggggaaccgacttaaagatgaaaaggcaaattagacctcgaagaattactatagagttattagcaaatgtaaagggcatggatgtaattgtacatgggctgtgtcccttgcctataaatagatgaacagtactcctgtactgttcacgctgacttggcattcgctttctgcattacgcctgtacctttactttctgtcaaaccgaaggtatatttataatttgttattctggatatgataatgcaaataaaaataagttgatgataatatctatattatttttcgtatttcgtatatgaattgttccttatcatccattgtgtttacgaaggttttttccttcataacctttgtccggaattcattatatccgaagggatataatgtcttgaaggacgaaggactttaatatttaacactttttatgttgccttgttcttaactcgaagcatttgagaacaagtctccaacattggcgcccacctccggtgaactcacttccattttttgagttttgaacaccttcggcaagcatcaccttcgtc

SEQ ID NO: 12201 - DNA, 130 bp, Zea mays
acaaatatcctaccccgacagcagtttttcgcattcagtattattttctttttaataaggaacaattatgggaggcttaagtgctttttgtcgtttttaatctcttgtaacagtttcgctttttaccata

SEQ ID NO: 12202 - DNA, 1225 bp, Zea mays
ggtaaaaaaagaacaaaaatcctttcgctctcatcaccaccgtcctctcttcttcttattccaacaaccatcgtattttttcttttctatttcttttctctcatctgtatctggcttgagctcctggaaagtgaatcactcacgtctccactccctacggctgggctcctacccatggacacgtccatggccacgtggaaagatgcaacatgaactggaagcccgagcaggcgtcattagcctctgatgacagcatcagtcactcatcacttttatcttccttttgccactcagacatcaaccagtgaagttcatcgattcactggaccatccccttatatctataaaaggggatgcccagggccttctcaagagggagagggaggcacgggcggtaagaacgacggagacggactcactcaaacatcgaactccactctgcaacactaggcttctcaagaggcctagggctggttccctctctcacgaagcttgtagcccctactgcaagcaccccgtgtgcaagataatataagcatcatccctcctcttgtgtttaatcttgcatcaacccatctgggcagggacacgcaacatcaaattcactggtcggttgagggtcctagcggatccaaaacgccgacaaccacataacgcattacatgttccattatatggtcatcaaatatttgttaagcattctatgacactatggcccaaaatgtcgttaaaatagtaaaaaatatgactgaagcacaagttcatgcttttgagttaaatttatgttatgtattttatagtcacatgttaacgcgtatgagtgagggtgcaatgttctaatacccgtttaaccattagataaagatttttgttaaataatagatcaacaggtaaacctatatacatatcctaattgcgtacccgtcgatatatcgggtcgcgactcacgagtacccgtcgctatctccattcgctggtaggacctatgaacgtctttggttcgccagaaagctcttgcttatgggtccatctttccacggttgattctggtcgcccggcggccagaagcccagaacctttgctggcaggccgcgaaccaaccaaacagctgaagtctgacgacgagccttggttcagagaaacagggcactgggtttagagcccttcggatctagtattgtcgttcaccggcggcgaccaggccaaaccctagaaccttgccaag

SEQ ID NO: 12203 - DNA, 980 bp, Zea mays
cgactacagagagagccttttcagctatgaaatttgtgaagacacgtcttcgaagcaaaatgggagatgcctatttacgagattatctggtcgtttatattgaaagggaattagcggcaatgatttgttctgatgatattatcaagggctatgatctagctaatacacgtagagctaaattcaaaataactgagatgtaattttattttgtttgacaaaatagatgttgttttattatactgtttttaatgaagattatatatcaatatatacattgtgattggttctcttgctatttttatattgtgttcttactggtttggtcgcttggaggctaagtctgccccctctatcttcggatcctgtcttcgcccctgattccgaacgcccaactactagtatctcttctgtcttctccggttctccctatcccacctttccctccccaccacctacctaccgcttattcaccgtcgcctaccacctccccctcctccacgtgccgacttccgctccgcaccgccaatccgtcgtaaccctagcctagcccagcctggcctcacctgattccgattcgtccatgttcgccgcgaggaattttcctcccatgggttccgcatacgccgccgagaggacgccgatcgatggagaatgaggtgctgcgtctgccgcgtatcctccgccgggtgccgggccatgggcgtcgcgggacgggccaatccgacgtcgtcgctgcgcagccgacgctgcctccgcatgcggccgtcttacgccccgttctccgagcccttcactgaacccccggcacccgccgcaccatcataccctgctgccgcgcacagtgcgtaggagccgcgggcggaccaccgacatcttcggcgatctccattcctctttgcttcctctctctctctctctctctctctccccctccccccctctcgctcgtagagtcatttgcttgtcggggccgatccgga

SEQ ID NO: 12204 - DNA, 720 bp, Zea mays
ttgcattatttacatgggaattagctaaaaaactaacatgtcctatagaattagggaagcattagacaggacattgctcccctgtcctcctggcttgcagcctgcctcttgcgttgcgtacatgcgcgctgctaactgttagatgtgcatttttttgcactactagagattatatatagagtttgctaaagtttatataggttagcgaacttcaataaaacccctggctcaaatggattctttcgcatgacgatcgacttccctcaaatggattctgaagtggaggaatttcctgttttgtgcgctgattggtgctcttgcattgcaacacccgacaccggacgattttgtttgaggatgaggaccaaaactcaaaaactgctaaaccggagtccgtcgcagagacaaacaaaacaaccatcgattccactgtgccacatcgtataatcaccgcgtataaactagtagtgacccgcgcggcgcgatcgcaatcacgcgcaaacccaatcgcggagacaaagcacacaagcaaaagcaaccccgcgggccgcgctagcagtagtagccgaacgaggaggagcctcgaatccagccaggccaggctcctcccattcctcctctcccacgagctctcaccgctcctcgcggcggcaaaaccccccttgaattccctacgcgcccgcctccaatcccgccagtccggcggcgacccagggatcc

SEQ ID NO: 12205 - DNA, 204 bp, Zea mays
tgttggggcgaaggcgaagacgctacccttcgctcgatgccttagccaatctcgctgcaccaacggaggcaaaacgaccggccgggttccacccttcgtccactacgctgcaagacgaaggcctacgacgaggtcgcccacgtcccgcgtcctcgtcgaacacgaaggcccacgtggaattcgacccattgtaacaggccccgc

SEQ ID NO: 12206 - DNA, 1500 bp, Zea mays
tttcttttggaaccgaaccgacctcgcgctagggttactcgcgcacgacgcctacatctgtcaaccacaacccaagcgctcccccctccccgtcgcctgcaggatctcctcgggccaaggaatcgttcccctccggcgaccttcctccctccctccgttccgtttcgggtgagtctacacgcacggcaccgcaccgcaccgcaccggatctttctccggccggatccgccatcgattttggtcgcgcgccagtcaatcggcggatgcggatggaatctaatggccggatctacgccgtccttgccttaatccttccccgcgacgcccgccatgatcctcctcgcctgacctctcctctctcgtttccagtccttccactgtatcaccggcaaagcaaaggatcggaggccactccgcccggaggagcaaggtaagccggctgcctctgtatctgtctgtgctatgctctaggttgggattagttctgtcctgcaaatttgcccaccttgctgttaatttttgtcttgtatgaggtcaaaagaaagggaataagggatgctatcagacggcgtgaaatcgttactcagggctgcctgtatgcttgctactatgtgtgcgtacaagatgcttgtgtttaggcgtgcccaccacctgtcacctatggccccttggctgaaatagacaaaattaggatggcaaaccttaggttcagttttccacaatgatcatcgacgccgtgcatgtgcgtgagagaaccccctatttttccacttgtgcacaatgattaggacacggcgtttgcttacagataccattaacagctccgtcgaggaactagttaccatgtttcaccaggccagagtcgtaggtttaggttggtgctctgttttaggtggggtttggaaacagtcggtcattacttgcacatagttttgtatgctattacaaatctatgtggagagatatgattcggttaccgtccttgatgtctaccctaaatttgcaaacagccaaaggttcaacctgtaatagtatccttccaaacttagatgtgtcatacatgtactaatgcaagaataatgttttttaattgaccatgaaattggtcttgtgcctttatggatatataaatcatcggttaaaatgcagacatatggctgcttggtctattattttatcaacaacaaacttggtgatgatgtcgtccgtttccggtgacttccacacataactttttacttattctttagtggcacatctttgtataccggtctactcttcattttatctgtgtctctttcccatagcttgttgagcattgatgcaaaatggttatgaacaattatgttgagccaggacaccttgctatgttttagtgatcagaccttcagctctatttatctattttatgcatggaatgacatcagtaacagccctattacttttaattccagccgactctgagcattggagttgtgcttgttcaaaagtgtgaattgc

SEQ ID NO: 12207 - DNA, 517 bp, Zea mays
taggtcacgttgttagaaatactgttagagtcgagtatatttgcatttgtatacatgctagcgggggcaccagactggggcccaatttcgtcgatggtgccgatatccacctccccgctccatccgctgtgggccctacttcccgcggctcctccacagtcatcaaaacagcaaccgccctctctctctctccatctccttcacgccacaccacaagtgtcgaaacggatcaaagagcaagcgacggggacgagagagacgagaggaccgtcgtctccccctcctccctcacaactcacacgcgagacggagacgcggccgcagccgaggtctgcataaaagcgcaaaagatctctcgctctcggctctcctcctctccccctcacccccggtgcgctgtctgtgtcccgtctccgcgagaccgcgagcaagttctgtcttcgtccgtccatccgtgcccggtcttactgttggcgctccttgattagcttacccccgccggcgagttcaccctgac

SEQ ID NO: 12208 - DNA, 443 bp, Zea mays
gagaaatcatcgtatacctaactttatatcgaacaaaatccatcgattattcaggtttcaagtaacatctctacccgaacccatggacggctgctcgggcccgacggtgctgccgacgcggtatcggcgcctcttctcttttaccgcagcccgtcctgagtcctgaccgggcctcgacttctctccactccaaacggccgcatatgggccgaactgacttcaggtagcgcaaacatgcctgaaagcacgcatatgggccacaccgcatcctctgcgtccatccgcctcttgggcgcctgcgtaccgcacgatcgaaccctggaaaccctcgaatcaaatatatatgtagtccgccagccaaactgaagttctcgagcacctgcagcgccgccagacactccgtagtctgtaccccaagcaccggcgcggcggcggcggctacc

SEQ ID NO: 12209 - DNA, 849 bp, Zea mays
ataccaaacttgcttctttagacttgccacttgaaataaatgagaaggtacaggttctacttattcattttccagcacaattgatgagtttctcaatatttaaaacattttatgttctaaacaggcacctcgatgtcaccccaacgcgacgctctctcctcttgaagctccagaattcaggatcaagtcagaagcgaatgggtcagctaatgctgttgtccccgcggttccctgtttttttccgcttgcatttgctccgctatttcactttttatatcattccttgattgtgaacaattgccaatgtgtatttccccgacagaatgaagtaactaactgtggctatggcttttacttttcatgtggcaattagtcctacgtgaggctaattagaatatggaatgtctcatacctttactatctttctttgaagaaagtaagaatatttgccaagacatgtttctaaattaaatttgtgcttccgtcctgtgcttgttgctggcaggtatacctttcttaagtgctctgctgtgtggtctgcatttttatgtacttctgtagcttcaagctccaggaaattcttttttcctcaaccacaactccacaagtatgccgagagcccgagaggactggtgtctagctgtctgctgtagtttgtagacagggtggacatctaggtccgagctctcgattcttggaatttctgcaatctaatttcttttctgaacttcgttatctgactgcaatttaggtctgagaaaatttgctgctctccttggttattttgctgtagcgtggagttggcatttggtcagctctcttgctgttcatccagggtgctgtagtagt

SEQ ID NO: 12210 - DNA, 962 bp, Zea mays
actccactccaaccatccaagcattcatcacacttcattcaatacaagagcaaagtgcaacactctaagacacaaatcaaagccactgatccaatcaaagtccccaattgaattctagtgctttaggacttgtgagaggatcgttcttgtgtttctttgttgctcttgttgcttggttggctttcttctttctctcattcttattctcaaagccatgtaagcgaagcaagagacaccaatcgtgtggtggtccttgcggggtctaagtgacccgagaaatcaaggaagaaagctcactcggtctaagtgaccgtttgagagagggaaagggttgaaagagacccggtctttgtgaccacctcaacgggtactaggttctttagaaccaaacctcagtaaaacaaatcaccgtgtcatccgctttatttcttggttgatttgttttcccctctctcccggacttgacattagttctaacgctaaccccggcttgtagtgtgtgcttaagtttgtaaatttcagtttccgcctatccaccccctctaggcgattttcaattggtatcagagcccggtgcttcatttgagtctaaccactcgaagtgatatcgagagatcacgccaagagagagatcgtaaccggcggtgacaaatccgcaagctcggggagaactcattcgaaggagtccggccacaagcataaggaggaatcctcttcctccatcaagtcataacgaagaggtgacaagaagaagaagaagaagatgaaaaaagtggtctactacgagaccgactatttgtcaccctccacctccggctctgaatcgtcatccgtcacttctaagcgccatgagcgcaagaagtatagtaagatgcccctccgctatcctcacatttctaaacacactccattactttctgttcccctaggcaaaccaccatttttatggtgatgattattgt

SEQ ID NO: 12211 - DNA, 1426 bp, Zea mays
atctccggttgctgctgcgtggactaggctacccgcgaagatgaatgccgtttcgtgataagccaacgatgatggatcattctagctaatgcatcatataatggtcatcgatgttgctgtggatatatgtattttcctgacgatgggcaagtaacattctccccctttttcactctagtgggatcctatttatctgaggtgtggcacctgcctgttcactctactgataaacaatgtctgtcaatgaacatgcgtggaagagaaccatcaggtggctaatttttggcaggcatctggataatttcaccggagaattcagaaaaacagatgggataaattggttactaagaattttgctttttggcaaaatattaaccaagtttgctgctaaaaatctcgaagccgactaaaaccggtcagttacctgcaacacatatttttctaggagaaaatgtcactgcacatttgcatatgaagccactcaatcaaaataaatggcatcgagaggaacaaatgaaaaggaaaaacgtaaaaaattgcttcgattttttaaaagtaaaatttaaaaaactgaaaggaggaaagaataaaaactttaaagaattcaaaattttaaaacaaaaaacgaaaagtttataagaggaatttaaaaattagaggtaaaacaaaaacttaaaaactaaatataagaaattttgaaaaaaatgctggctgtggggttcgaacccacgcgcagttcaactgcagaagatcttaagtcttcccccttaaccactcgggcaaaccagctgatttaatattggtacctttgtagtataatatatatcaaatttgttattatttatttatatccattcattcagacttcagaccagagtgaaacgttgagaacctgaaccattggagtaaagattttactggcttagtgcagcaaaccctacatgactgatgtcagttacctagagtgctggcacaaggatggaagtagtagtgtgtgtggtgtacctgtcagttgatctaattaatttgccgatgactaaccaaggtgaatgtgacatgactactaattaaacacctcctcagcactccaatatcaggaatggccaagaatcagaaaaaaaaccgaaagaaatgatgtgtgtgcgagttgggaaccgagcaacacaaagtcgagcttcagcttccgaaggcacgagggcaacgcagattccctttaaatataaacgaccagataatcccgtaaataggtatctcctattttgtttcgaagacgtgtcttcacaaatttcatagctgaaaaggctctctctgtggtcgcagttgacacagagagagtcaagagtaatctcaataatttatctaccatcggataaaaagaatctttacccacccagcttaactaatccacttgttaaatcaaccaaag

SEQ ID NO: 12212 - DNA, 1500 bp, Zea mays
aaaacgagttcgagaggaatcgtccgatccgcatcaactaactaacaccacaccgatcgcaattgtctaatcgattaacagaacgcagtgagatcatactaggcagctagctagctagtcgttgcttccaagccatcttgtcgtcagatgtcgtcgtcttcctgacctactgcgcgcagctagccgcgtactgtacgcgaagtggtgcagcagctagctacacgtggacgtacgtggtggctgcgaatgttcccggccagccacaaatccacaacacgcgacgtacggttttcgcgggattagtttctgagtcggccagcgttcgtttcgcacgcgtggctagtagccgcgcgcgccgaatcattctcgttcacttgcagcagagtcgcacctgtgctgccgttgcgctgctgacattctgccgcgtcggaaccatgcctaaaacgtgccccgtttcgtctcggtcagcctgccacgcagtggtcgtggaatcacaacacatgcacagcacagacgatcaggagacgacgcacgagacgagaatgattgatgacacggagaccagcagcgacagcgaccaagtaaatagctcgctcgccgttttcaatacagtaactgattcgatgcagcagcagattacataaattcgtgcagggagttgcatgcgctcggcttgagcgccccggccgctccacaacagtttgaattcgaagagggtcggtcggtcctccaccacaaggtcgaaaagggtcgtgccaaaaaaacgcaaaggagacgtcccttttgtgtaggcacctagaaaccagatacatgtacacacaaatacacgccgacaagtttcaccggcgggtgccacagcgaaccgcacgagacgtacgccacagtggcagaggaggggggtgggagagaaggcactcactggtcgatgctgcaccacagctcatctaaaaaagagcagaagtcatataaggggtaaaggaaaggctacgaaagagagacaaaactcagcagcgaaagtggtgggggacgaggagggcagagcagggctcccccacccctgatctcaacctctccaccccccaaatgggaccctaacaaatcatgattccaaatggagccgcaattcaaaaaggttaaccaactcacatccaaatccagcacaaacccgccgtgtaaaaccagagtaactcccaccaggccaccactaccgggtaacgtcactgacatcctggacccacaaggctgcgcccacctatcaggctgtcactgacggttattaggtgtggggtagtctagtaagccggtgcagcaagcgcactgtaatctgtaaacagttttgtcagcgacacggcgccccaccggcagggcctgtgaataaatccgcagaccgcagccataataacacccgcagacgagccagcggtctgcgcccaccaccagtccaccaccacccacccgcaaagccaaccacaggagctggagctgccgcggccaaggaca

SEQ ID NO: 12213 - DNA, 1500 bp, Zea mays
ttattattgtatagtctgattaagttggcacagctcgcgagtcaggacaaggtgactcgacttggtgaagcagcaagctcgaaaataagactcggctagactcgctcgagactcacgagtttcgagtttttttatccagacctaattgacgaggataagatcccatgtcctccatgactctatctcaagccttagatgggccttaactcggcctcaaattagaattcccgtctggagtgtccatgcgtttattgacttgagcacagtactgcaagccacctccacacatggtgcctatttagacgtactgggccagtgcctagacgcacgttcgcgctcgccgaattctcgcggagtggatgaggtcgcgcggctgggaggcaagcttgctaggatcgcggcggcactctgccggcttctcgccgcagcgtgacgggctgccgtgcgtgcgactgtatcggagtcggaggagaggtcgtgacttggtgagcagttgattgggggacggcgagcgagatttgtggcggtcccctgacgacggatacgctcgatcgcgcgcggataatctggggaggcggcggagactagttgaccgttaaggcgaaccgtctcgggatcgggattcacaaggcgtgtgcccggccgccgccaactgaaataacggtcattccgacagtgaagttaaccggtgcgctcagatacggatcacctcaagcccagctgctgatggcaagtggcctggtcgttttaacttgctagtgtactccaatacggccggatagacacaaaagcccttcgatggattcagcatttctgcctaagctgaaaatccacctgcgatgaataatgcgataatgagggttagtttgaaaaccccattttctcaaaagttttcatttttcaagggaaactagtttattttttcttagaaaaatagaaattccttaaaaaatagagtttttcttagaaaatgaagtttacaaactagccgaaaggtactaactttcattcatatgcacaatgccctgcgacttccaagttccaccacgcagctcttcacctagatgtctactagatctacgtaccctacccgggaaggcggagtgcgaattgccatgcctccaatcagagatcaaggattggacaagtgagctgcacacaaaaggaccggaccggaccggcctaatagttgtactagctctctagctagctagggcagttatactaagtggtttgttaatcacagttatctgccatcatcatgttgaccctagccatgtgcaggcacgcgatgaacaatccaacagaggaagcaaccagagtgagatctgtttccctgcatgcattagacaccatatattggctgcctataaataggccagcagagaaccaaagctagcagcaactcacaaatctcacatctacttgcgccccttctcccaattcatcctagcagcaagcatatattgagccacttgagtactgtaacaacagctctat

SEQ ID NO: 12214 - DNA, 97 bp, Zea mays
caagtaactgcagaggtgacaactactagggggggtgagctgtaaactagtagcatttcaattgggaagtctgcattgtacattttttacgtgtact

SEQ ID NO: 12215 - DNA, 691 bp, Zea mays
tttggtacgaatagccgtggamagaactatttgcttacctgggaggctgggagagactagaggactaatctgaattctcctattatgttaacacaacagacttcaaacgagattttttttaaaaaaaaaatcaatacatattgtatcgtcgatggtctaatgataaaattgaaaaggtgcagtgcaggctaatgtactctgccagggaacaggtgcagcctaaagtactcacacttctgcccggaattgcttgggcggggggcggcagcaaatatgagatgccttctccgattaatatacagtggactactctattacagcagtaataccgatcggtggctgttattttccctctaatcatcatcagagcgtcaccatcgctcacgcgcgcgcgcagtcaaagctgcaagtcgacagcacgcgcacttggagtcaattcggcggccccggaatcttctcgttttatcagcctctctctgtaacaatccacacgcaacaagacagacgatgctccacgtagtatacaaaacacgcgcataccagtctaaactcgaagccctgattgggagctcagctgattgagcagtccaagaaccaaaggataaggtgggtgggcgcctgggcggggaccgccggagccgggagggacgagaagcgagcgaggtgccgtcgtcagctagcactagcagcc

SEQ ID NO: 12216 - DNA, 179 bp, Zea mays
ttgccgccgcgggtggcttcttgctcaggaaggcacgggaatcaggggactgaagagccgtctgctgagtgttgtgtctgatgtctggatgtcagagtgagtgagtgagtgagtgacggcaggaggcgaaggcttgctcacttttataggcgcagagcagatgagatgctgctggggac

SEQ ID NO: 12217 - DNA, 572 bp, Zea mays
gtgtggtgtttatggtctataagttaaactaatgattaatgaaatgtgtctgtgttaaattgatctatgcaaatataattatgggttaaatctctactacttattaaggctgcaatagtagcctgcctttttgtgttctgccgattcggtctctgacaggtagggcccacatactgacaggttccccgtgcatgctcctggttcagccaaaaaaatacatcccacaacgcatccggtgaccacaacagtactactacgcgcacaggtaggcatataagcagatttaaacaccaaccggtgggcaatgtggtactaattttaacttgcaaaccatgaagacaaagacacatgcgccatatgaggcccatctgccaatttgtacgaggcccatctcccacgacaaatgaaaaccctaatctccagcaccccagcggccgccagcgctcccgctccttgctcgcctccacccgcggccaccaccgccctgcggcccccgccgcttgctagcctccaccgcgccgcgagtcacgccgttcctgcaccggctggtcctggagcacgggaggacgagc

SEQ ID NO: 12218 - DNA, 1500 bp, Zea mays
ttcctgggctcccctccgctcccaggccgtgtggtttaataggggcgggcgagcgccgtggcgccacgtggcgacgcggccgcggggattgggttgccgccgggaggatgacacgcagggccctccccacagggactgactcgcgccgtgtggttctgttgctggtggctggtgctcgcggtgggcacgccgcctcttcctttccctttccctctcctctcctctcctccacggtccgggctagatttccattctctccgtattccggttctcgcgtgcagtgtggtggactggagctggaggctccggcccccggttttgggggtttgtttcttcttttttccttgttgccttgttctcgtctcgccctggatttatccggcgccaaagctgcttttcctgcggcgatgcgtttttttactcgtcacatactgttacatttgatccggtattttaatttgttagctcttttcaaattattcgcatttatatatgtgtttttacactatgatctcggcaccatagttcatgtgccaatatatttggtatggggaccaatttggcgcttcagcccacggggtgtttggttaccctaaactaaactttagcccctatcacatcgaatgtttgaacctccgttccgggtattaaatgtagtcggattataaaactaatttgtcagccgaagattaaaagacgagacgaatctagtccagttggttgggtctatatttcatactcctatttaaaagtcaaacgtttgatgtgacccggactaaactttagcaggggcaaccaaacaccccctaattgaaaccaaacatggggacatatctggtgcacatagaagacaggttgcacatggtgcacatattaaatcattatcactcattttagatctaacgtctctagttgattattcaatttacaaataacaccttccaccactacacaccaccacgttgaagggtgtccttagtaaaatgtaccaaacaactagagacgttagatctaaaatgagtggtgatgatttaatatgtgtaccatgtgcaccaatgttccatgtgtaccagatatgttgtcaaacataagacctcctcaccttttcacctgctgtgcgtgcataaccccggcctgtttctgcggattggatgcacccccttgctgcagcgggagccgggagatgagatccgttccttgcacacagcaaaagcaacggaccccatccagcctccaacgtactctccaatcggcagcaaggaatggcacctggcttcctcgcaaagcaagaaatcgtacgtacgtctctgccttgctttgccaccgatcttacctttcaacccaagaaatgctgctagtagcctcgtatcctttctgcggcatctctgcatatatacggccgggacgcgctgatgcattcacgcacccacaaggttgagagctgagactgatctgtgccatccgtccgttcccgcgagcgagagaggccggccgcagcat

SEQ ID NO: 12219 - DNA, 972 bp, Zea mays
gtgctcattcctcctaggaggttcacgaagagaaactatagtaaaaaacatggcttgttggagtgtttctctagagtgaatattacggcgcccttattgtgggcttggcttgtgatgctaattagcgcatgtatcatctagcttggactcgtcacaacgaggacataggttgtcgacaaccaacctatcctcgaggatatatctcgtatcatctcttgctccatgtggtttgcactccttaaaattacttttactagttgtttcgtattagtctatctagtctggtgtattttgtaattaagttttatctcttgctgagtgaacaacttgagtagttctatacaatccctttacaagctactagttttattaggagatagcttaaagtaaattagcactagtgttgtaaatggtcattttgtagtgcttgacatgaaagatccaacaccaagagaagaagagaatttgcaattaaacgatcaagctctcgatgtaatctatgaagatattgatctagaagtctttcaatcaatcaaagatttgaaatttgcatataaagtttgaaaaggactacatatgagggtacactggccgtgaaaaaagcaaagctttacatcttcaaatataaatatgtaaagttcaaaatgtaagaagatgagagtgcgatggaaatgtttcataggctcaatatcattataaatgagctaagggacttgggttataagtggatgtgaggacttctctcataggttcttaaggtgcttgcctccaagatttgacactctagtcacaatcattgtgagaggcagggctaaaaggagtaacctcaacctaagtattaggtgatgtagtcacacatgtggaaagggatgagaaagacagagaagatgagaagaagaaaaatgaggcattcaaatttcgaagccaccacctcactaagtgcaagagcaaggggaaaagaatttagtgaca

SEQ ID NO: 12220 - DNA, 462 bp, Zea mays
tgattgtaatttcttacaggctacgtcctgtgcctataaatagatgaacagtactccttcactgttcacgcaatctagtaattgctaacacattactctggaattattgttttctgccaagacgaaggtataaatgtacctaaatattatattttaatatttaagttcacattataaaataaatgaataatgttatttattcttggtattctataacgttttatattttatatttcatttcatattgttttatctttgatcacgaaggtgcgaccttcgtgatatattattcataaccttcgtccgaagctcattaaatccttggggaaataatgcttcagcggacgaagggctttaacatttaacattctatgttgccttgttcttaattcatagcatttgagaacaagtccccaacattggcgcccacctccggtgaactcacttccactttttgagctg

SEQ ID NO: 12221 - DNA, 1500 bp, Zea mays
ttgacgagacaagagagagagagagagagagagagagagagagagagagagcataaggaagcttctgagcatcaatgaaaagcaggagctgtacagatcaccatatgattattattattataaaaaaacgctcaatcaacgataatcgtggtcctgcctttttttctaatcggaacggtatccgcaggcacatgggggcgctatgaggatgcccgttgcgttgcattgcatcttccaatcatcgcgtcatgaaccacaccaggaggacgcacgcctcttccagcagacaggcaggcaggggagggaggaatacaacaaacaaaacgctagctagggttagccgcgcgcacggcgcacctcatccagactattatacccctagctagctagtgtgtcctgtctccgaggcacggcatcgcgtggaagttttcgcgccagaaccataaaaaaaaacaaccaaccaacatacctctagccacagccgatgcaatcatctgtacagatcggaggtccgattctctcggctgattgcgaacgtctttgggattggacaagaggtttctgattggagaccctcggggtcctaaagaaaaaaaaatttgcttcgctggctggatggacgacacgacacagagggaaaaggaagatgctccgtgttcctctgcaacgcaaaatgcttttgatccggcatcctaattattggctccaggtaacaagtgacccagagttgtctctctgcgacaacagacgacggtgctagagaccctagcgtacatgttttgatgagtgagaagttttcccggttgtgtagtttccctgcttcaggtcacactcattcagagtaccaaaaaaaaaaagacaaaaaagaaaattgagcatcaatccttttcccaatcgtgtaatcttttttacttagctggcttgagtacaaagtaacaatatttcttgatataggaaggacgaactgtcgggagttccttgtagtagtttatggtagtgacgttgcagtaatagcgtaccagcarggggggctctgaagcccaccgacggttgatgaagggacacaaattctaggggaggcgctgataagacacaaggacacacgttttctacagagaagcaaagggaaaggctaagacgctcccacagccacgagctttaaaagaaggagaagagagtggcccttaaccctaccgttctcttctccctaatcctggtaatcagtagtagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaaggatacccgtgctgctggctgctgctgctgctcctcaagytagagccgtgtgtgggctgtgcagattgcagagcgcagcttccagtctcagcattgctttca

SEQ ID NO: 12222 - DNA, 1500 bp, Zea mays
gacaccagacgagtattaacactagcgaacgaatatcaactataggaggggcggtggatcgagaaaacttaccagcgatggaactgtcagccgactccgcggctggaggtaggtgacggcgaaatgcactattagtcgaacccactgctgaagaagattccgctgcacgccgaggtcagcttcgctcgcctcccagtcgtagcggagaaatgagaaatgcggaggatgcggaggagacgaggtggcggttgtttaggaagcctaccgccgtgattgaaggtgggctacgtgtgggtttgatttgtttcctaacagacgttggctatgggttggtttgagttgcaaactggtaaggtcgaaccaactaatttggaccagggcttccgtttgttaatgtgagcccaatgttctaaatatataaactatatatatatatatatatatatatatatatatatatatatatatatatatatatatatagacgtgttacatttataacacttaaaaagataataataattgactctacctataaatcgtagctacaccactgatcaagagataagatgggtcaatccatctgtcacccaacaacatttttaatattattattattgttatcacaagarcaagtttaataatataaactatagtgggccttatagtgttgttatgtaatacagtatatagccaactaaaagtctaatcatataataacgatctcatgatacaacttgtacattaagaacttgatccaccctctctcacagagtgtcttggcgtaacacccttttttgaaccaagatttagtttgatttattaagatttgagtggcttagaatcacaaattatagttttaagtattttcttttgttataaaacaattaaaataaaatataaggttgaacttgctttgttgcattcatgtcgttgtgtagtgtttctaagtgcaaaacatgtttctagaatatatcattggtttagttttaaaaaatatttggattatacttattataactttgtcatattaaacatcgatatatcattggtttagttttaaaaaaataaccttcacttaaccgtctctcttttgatctattcctgctactaataaatatagtagaatatttgtcgttcgttagtttatttttaaactaaactgtgataaataaaaagaacgagagaaacttgacacgttacgcgatatgacgatgctcgacacactccgtcttaggtcgacatagcgcgacaagcctttggtgcacaacacatgcatggtgtcctctcctattcccatgcagaattattaaagcacgtagttctaagagttttcaatcaatgagtcgtttgaaattcccatatcaggtcagacaatctatgctagctgtatttaagtatcttgtgtttctccattaagctctcacgctatgcccttcaatctacccacgacataccaagaaaactagcgagatttagagaggagatttagattacgag

SEQ ID NO: 12223 - DNA, 282 bp, Zea mays
atgctcgtgcaagcaattcatcatggccgtgctacatcaacgttaactacaatacgtacaatattaaatacagacgtctcaattaaccatatatacagcaatgtggcagaaatgatacatcagcctacattccagacgtctcactgccatgtaaatcagagtggcgctcttatatataaaaaggcagtattccccccatagtccattcaactccaccgcgaccatttaagcaacacagcagcggcatctcagctctgttcccagctagttagccgcggcgcc

SEQ ID NO: 12224 - DNA, 1500 bp, Zea mays
tcctatctccagcaagcaaacagaagcttgcccttaatgttttttaaaggaaaaaattaatctgatttataatgtactaacaaatatcattatcgatcgaaaacgattgctagctggtaaaaaaattacccggtttcataactattctacttattgacgacatgctaaatagatatttgaaattcaaattttaaatacggtaattttggaaacgatattgttttcagaaaacgatacggttacagggctccagttacagtattttttattacggcttccagccctcgtgtactatatgtctcgtgttagaggatatcaggataggtaaaatcgagaagaatgcaaaatttaaaagggtgagaaagaaaaaaaagcaaataaattgcgaaaggaatatatgtgacgaataacggcccagtagaaggcccgtgcgggtgcgcctctcccttgttgaatatcccagacttggccggatgtccgccacatttgcacttctgtttaccggttcatggaatgacggaagtgttcaccccggtcgcggcccaaaaatcagcgaataggcccatcagctccagccgcgcgaccgcgtgaacactgaacagccccccggtcgctcctcctccctctaccctccagctccagccgccagccgccagccgcccacgcccggagcaccgccgcaacccgcagcgccgctcgcccggaggccggagcaccgccgctctccccgcacggagcaccgccgcgaccacgccgctgtccatccgccgctccgcgctccctccttcgaccttcgccttggttccgacgcggtgaccgtgcgctaaacccttcgaccttcgcccggaggcgggagcgcggcggaccggagtccggagcaaccgtgagacgagcaggggcggccggcgggcgcggatatttgggcgcaacaactttctgcccttccatcttctccaaccaagaaggtgggaaatctaggcctacctcccgtggagctcgatctggagtgggacatcgattctgctaatttgtgacagatcatgcaggaataggaggccaagagaatttctacaaccacaatgaagacgacaccaggacgatgaagtccggtcgaccggattttgtagttcctcgattgttgcttccttaggtatgtcgatggatgggtctgataattgttctgataaatcatttagtaggttcacatagtgagcatccattgttgcgtggtggattgataaaatttctcagcattgttggcattgacttcatgcatgtcatcattggtggcaccatattcaggctaaccactagccatttctaggatttttcttctctcatgttcttataatttgatatctgttccttgtcttctctctcaacatcgtgatctacatgtgaaacaaaggcaagttcaagaggcggggggacgcaaattcgtaagtggtggattcctctcggggcaccgcgggcgggcagccgcctgtggaacctgctaag

SEQ ID NO: 12225 - DNA, 1500 bp, Zea mays
aattaccgaatttgttttcgaatccataccggattttatatctatcatttaagaaaatatatgatgaatttaaggattaacttttatgaatctttacaagctcaacgttataaacaagaatacaaatttgtatagtgcattacatatcctatttattcgcaatcaaagaaaaacgactaaaaaactgattaccgaataaatatcgtttccgaccgttttcatccctacttctagggacccctgccttctgggttgtggtcaccagctcgtctatctcactctataatttaaaagtgtactgtataagcagtattttacatatacactcttgtgatattcagcctcacaaagccacaagtacttgacacttgcgtaggaaatacattttttctctcaagtaaatcaatataagggtgcatttttaggtcgagtttggcaattggacaacgacaagtgaaacagaattggtggtggacacagataatttgaaaggaagacacataagtccagctgctcatgttgagacaaatcaagggaattttgtcttagtacaacacccttgtgttgagaggcttcaacgaccaccgattaaccatgctagctcagcttgtcgcaaggaagagcgaccacgtacgacgacgaccttggcgaggaaatgaataagcgaagcataagaccccggcctggctggtgagcacgacggcgaaggagacggattaggagattggcaggatacctgtctaggtgacgaggaagttggagagaagactgggtggagcaggggcggccgtaatagatcgtggttcaaatgtttttttataaatagtttaagatcttaaataattttagttcaaaagtgaatatacataaaactcaattttaatccgttctgatcctgaattttatagatcctaaattttatagtgtaaattttagaatccattttcacccctagaggaggtgcaaaccagtggtgggcgatacgcagacgagcctcaaccgtgggtgactcacaagacaagcaaccgagagaaaattttggtctgactatactcaccgagacgaagcaaccgagatataaaaaaaaactacagtattaattaaaccatggtttaatactatgtagtattactacggaactccataaataccacgttcaaacagggtcttaaaagcgtagagataacacacacaccgagcgcacgtcggcaggtcggcacgtcgacgcatggcgcagagtgcgactgtgctcggatggtcatcaaccaaccacgctgggccggccgggtcccctcccctcccctctacgacagcttgtttggttgtattgtttttgagctagcaagcaccggcctcaacaccggtagtacgtagcgtaggtatcgtccactcgtccggccgtcgcgcgcgctgctcctgccttcttcctctcgctgatatattggcgacgcacttacgatcgaggccagcagctggggttggacttggatagctagctag

SEQ ID NO: 12226 - DNA, 1500 bp, Zea mays
acagtagcagcgtatcttccagctccacgtgtttcaatgacgataggtggctagttgtcttgatgtgtgtcgttcttattgcgatgatggcaattgttctgacgattgccactggccatctgattgcccccaccacgggggtgtagggtcgtgagggccgcctagggttgtgtgtgccaccggtggggttgggagtgttgtcggagggggtgaacctgtagaagagtggactacggtggagaacaacgttgtggactgtgatgtcacctttttattgagggttaattcttctagaaaaagggcatgttttggatcccctttgctaaactttaatagggtgctaaagtttagcacatcttgaggaactaaacctaattgggtgctaaagtttaacacttcacttttagcaccttttagcaatcatgttttggatctccaagtactaaaagtgtaatgctaaactttagtaccctggatccaaacaagccctaaatcatctcaaaccttgtcgaatgttggtagcagtatctagcgttttggtgaaggatgtgatgtgcacatacagatcattgagatcgcagagtgtggccaaaattagggtgcgacctctcaccaaagctaccaagttgatcgactatggacttgaggcgacgacaatagtctaagatggacaagtcatgttgcgcaaaggtatttatttactgtttgtagctcttaaaattatatgtaggttataccttaggagttatagtgtttaactagcttctctttagagttttcttctctagatatcattgttagatacgctctagaagcaatgaagttactctctttcactttgatttcgagttcgcagcattttaacatgaaaagagccaaaaagagtctcctaatttgttggatcataatctaaccataaatataacagtggtttgttagatttttttatataaacctatgtgagtcggtggtaaaagagtttaagtgttaaatatgatatttgattgtatcacgatataacagactaaaagtctcgttgcgtatttaaactatgttgtttgaatcagcaaaaatcctgctatgtggaatgtaacaaagagtgttgtgctctattgcagtgctcagtggtaaatggagagaacagagatagaatgacagggtagatctttattgcagtgtagtgaagtatatatacaagagttcccaaggggtgtgtcccttgggaaataactgtcactacgacatatggatggattagatcacatgtataaaatgttttataacaatgtgaaaccacatctgtggaactttcagtgtgtgatgactgggtcactggtggaataccgtgttttctgagctggtcgctttcagttcgcggccaaagtcgatagctcaactatcttttgagtttagctcccaggttctttggcttcatttcaacaagcccgatcttcttctgacctctaaggtaaacctgcgaggaaaccattcccaaagagc

SEQ ID NO: 12227 - DNA, 1495 bp, Zea mays
gatccagctatatatatgtatcgatctgctagcgagcttaggtagctgatgaatccgccgctgcctgcctcgtctgattagaatttatttatagcgggagggaagggatttggacgactggtgggggtgcaccgtgcatggatggtgaccacctaccgctgcgttgcctgtccgtccgtacctatgggccgctccagcttcgttcgtcgtcgttagtttatccgtccaatcagtggcggagctctataaaattagtactcggagccatttttaaaaagctctttaagatatcgtgcgtacaacaaacatagactaaagtaatatttatctcaattcagcaccttaaaatatgacaaaacttgataaaaagttaaaattatctaattaaagatgatttggtccttcctcacctctaatagcttcacaaacatcagcacatgtgagcctgctttgagttccttcttcaaaacttgcttgttgcgctttctaccgatgaggaccacgagttacctttcaattttttttgatataaactttctaccagctgaagagaatgttgctcctgcaaacttcattaaatggcctacgacacaagatcatccaatcgagaataatatgcaatgggacaataactagatcgtcctgggatgtttcgctgcagctagagacaacaaacttcagtcgagcatgttctatcaagtgctgcgcggtggggggacgaccgtggatgaaggagctggtttgtttcatctggagaagcagggcgccgccatgggtgcaattctttggttggctggccctccgcgggcgcctacaatgtcgtgcgaatctcatcatcaagaatgtggtgcctgacatctgtgtggaaacttcagcgcacatcctgttccagtgtcaccgtggctgacctgtggaagccggagttggtgacgccgccgaccgccgtggaggagccgagccgccggcgaggggcggaaaacacaggcccgcgacgaaccgtggagggaggcaggaagcaaggcgcagggccgcagggaggtgaggaggtcgccgactgcccggttcgctggttgctagatccatggagggcgcgcagcggccatcgagcttgtcatagggagcactggtgactggccgtcgacctcgagtcgccgccagggcaaggttgaggctaggtcgatcagggttgcagccgccatacgcccaggcttcaagtggagaggaagaataaatggttgggctgaaaaaacctaagtataagtggatatttgggccacgacccgggccacggcccaggtggcctggtgcccaaatccgcccttggcccgtggtctcttatgcacttatgtaatctccagcaacttcagggttcttaaaatgtaaatgtagttaactatttctgcttcatgcattttgttgtgaatttatatttctttatggaacttttcttttttgcacactgatattccgattcatttttcatatgcggctgcag

SEQ ID NO: 12228 - DNA, 1500 bp, Zea mays
gtgtgcccacgccatgcctctgctcgtcgccagtgctcccaactccagcgtgtctacctcgcatccttgaagttgcatagactatgttcctatccagataaatattattacctcacactgtaaattcctctatgaaacacgggacaaaccatgcctatttattggtgttgaagaaatttttcaataaagagcgcattattaaactcaagagttagcatcacgccgatataacactaaataagatttcacgcctagcttctgcacaactagggtgcaaccaaagacttccatgcactatatttcgggtacaaggtttgggttcggttgctacctttaaaacccgaatagaataaataacacgaaatatataaaaaaaagttcttagtatgtgatggtattattatatgatttatgaatttgttagctaaaaatcatgatgatgtcatcctaacgatagcatatatatgtatattctattttctatagccacttgttataataatattacttctacttaaattatgcatcgtatatattttaacaaaatatactaatctatctactatttggtcttttcggtggatcgaacagatcgaaccaaaattatggatctattcggggttggtaatttcggattaccctaatagcctatttgaattaccctattagactgaatgcctagcatattaatatatgttaacagtatattataactcagacagcacaaaaagaaattccaagcggtaaaataatggtgctagcttggtgatggaggcaggccgccctcagctcctcctcacgtaacggctcaccgcaagcatttgtttgtttgtttgttttagaatggggggatagatagggttgttgagcgtgggcaggactgaacagcgcctcggctgtggatgcttgcatgacgacgctcgtcttttcttccctttttttggtgcattattcatcgaaccgtcccggaacgagaaaagaaaaatgaaaaaaaaaaacgcccccaatgggtgcgctggtcgcgaagtagtagtagccgtgtaacgcaacgcattggccttggccgtgaaaaaaaatctgggtggcttttgggaaggctcggctcgccgtaggcatgtcatgttcatggcgcatccacgtcgccctgcccatgagctcgctgctgtgctgggctcttgtctcggcacggcagtgtgaacggcatctgcagcgagaatatctgcccatgatttcaaccttttcctgccttcgctaggcttatccggcaacaaacaaaacctgcgctttttttttctggaggacggcgcgcgccggtgagcgtgtggatgaggcgcggcctacagcagaacccacccagtcgagggcaaaaagagcctcctcccccgtcactcgttgctccggctatatataacgaccggcgctatccgtgtcgcagcctcctcgcaggccgaccttgcgtacgtacgtcgtagcggctcgtccagctcgctcgccaccgcc

SEQ ID NO: 12229 - DNA, 951 bp, Zea mays
gagccatccgcccgttacctctcatcggacacggagccgcacctttctaccgtcaccttgctttggtttggatttcacgggagccatcagatgagcataaggtgaggcgtcccttcttgaactggtacattagaaaaggtgagagtatttttatttttacactaagttgttgtttggtttacgaaatgtaatataaacgataacagtaatgaatcatacttaaatatcagcggcaaaaaatttgaataaacatgtatcagtttttagtgtgatatccgactacggttggatttaaacaaacatgattgaacgttaatcagttaccgttcacactacaaatatatgaatcaaacaacatccaagcttttttatattttttacttaaaaaattacaacagaacaaagtcagatagagaactcggtttcgaaaacaggaacaaatatatgctaacaacgataccataatgttaatcagacatttcgaacctagaacaaagacattggtactaatttcccaagaaaatcaccggcaagatataaatatagacattttctgcccgctagctaaagacaaaaaaaacgatgacgactctctaaaatataaacaagatatataaaatttatcgaataatataaaatatagaaaatctttatctttaatcaaaaaacaattgtgtagtttctttttcatattttagattagcataaattattttattgttacacagaattttcgttagaattacgagaaatggtcgtacattcttcataaaacagggtgatgagtcgtacctgggccgctagataggatttccgagccacatcgcagtttattcggtgttcgagactagaagcctggagaaacgtttgttgttcttccagaacacgccctcggaatcctatcgcctcccacagcacacgacgcgcctttgctgaactctctctgtcgcc

SEQ ID NO: 12230 - DNA, 660 bp, Zea mays
cccgtcgaatcggaatttgaaaactgagtcatattccttcctttttttagacgcgttaacattgttggtcgaatctgaatttgaaaacaagagtcatattccttccttttttagacgcgttaatattgtcgctattgtgatcaacatttttcacttattaaaacaacgacggtcgacggatatacaaatttaactatggtttgtaaattgtaatcggtacacttcgttaaaaaaaattgtaatcggtactgccgtactggatatgctttcatccctcacttccgttcatcaaaaggagaaatgcgtgggtccacattgtcagtgcctgatttagtagagcgcactagcgaaaacccctctcgtatgtcgcatcgcgtctaaacccttctctccttcagtccttctcatccccacctccctcgcggatcactcgccgcctccgccgccgccgccggtatctcatacgcccccctcctcccttcctcgagtgagactcttcccgtgcccggaatccttacccgatccgtcgttctgcaggccgcagccgccgccgtgattctgtccctccaacttccttaaatcctagagccagcagcaggcaaccagcgccgacgaggaggaggagcgcggagtagaggggctccggcgaccgcgtcggag

SEQ ID NO: 12231 - DNA, 574 bp, Zea mays
acacgacagacatctgataaggccggtggcttttgctcggcacaggaaaaagagtaggcgccaaagcttatggcgctgatccctaacacgcaagcgccagatcatcgcagggtgcgagatctgggcgtcatctatattgccgccgagatatgtaactgagagcacctagagggggtgaatagataatcctgtaaaattcaacactaattgcacatacttgatttataaagtgttagttagactaaacaaagttgccatagagtgagctcttgagaagaaatcaatcagagaaaagcaacacaagagacacggtgttttatcgcgtggttcggccaagtaacacttgtcgaaccacacgataactcgcgtctcttgtgattgcttttctgtgtgattattgtgattcgcaagagctcgctctatagccacttggttttatcattctaacacttaaccaagttttgtggctattagttgttgaattttacaggatcacctattcaccacccctctaggtgctctcaattggtatcggagccgttctcttcacgaaagggactaatcgctcgaagag

SEQ ID NO: 12232 - DNA, 1500 bp, Zea mays
ttttttgcgtcacatcatcaacatttcaccccctaaatttccatcttccgcagcggttcccctatattatccccctatactccactacaactataaaatattattatctaaccctattcatcttttatttctatttttgttcaactattaaataggggagcactgtgcaaggggcgctacagtgctccccttgatctgggggaactgcgcgtcctcccctacggctgtagcacgtagggagccgtttagcgcgcgccgttgcagcgtgagcgtcactctaaatggctacagggctaggggagcgcgagtgtagcggatggcgttgcagctagcctaaatgatatatcggtggtccagaccccgatggagtcggtctaaacttctataaggaaagtgagtagtcattggtggactcgagggttgaaaaattgcaacggagtaacacaagttattggtgaacgcttgcacggtcttgcgagttgcattaagaaactaaaaaagcaaaatgtattttggctaactggactttagctaattagtcttagtgactgatcatagtccaaccgtaagtatttaacacttatatccttccaccaccagctcaataatctttataaaaaaacctctaacaaactatggttgtatctgtggttgaatcgtaatctaatggatcagatgatttgcttgcacgcttgcacagaaacactgtttgcatagccgtcattgctttcataagcagtgtgtcgttgtgagtcttcaggccgagcacacctaggccggcctacgatttgggctcacaaaccaaggcccatgcaacttgcagtggttttctgtcgtcccgccccaatcagagacagtgtctcctgagtttgttaatatgtttgatcacataagctggtaacatcaaggtgcacacgcagtatatgtaggcagcgccatgaggactgtgttgaccatctgaaagcagaaaaaaaacaaagttatggccacaattcttattttttgttattatactcaaaagtccttatttagcttgttatatgcattaagattctttgatatgcatcaacattaattactttatatgtactaattgtatactgataacattattataattacagttcagtaagcgtatgcatctagcgagaatggatttagagaaatgtctaaaatctacggggtccttttttatattctgtgagttagctagactcaaaagatagtgcaaccagtaagcacgaacagagacgaggaacttgtattcgacgagtttggctagatatatacatgcaactaaaccacaccatgatatacgtagaagggtagcttggcattattaacaccttagaatacgcagaaagggtagtttggtaatagtgacgaacacaataattagagaacctggcttccaagtttagtcaaaagtatccatgaattaagtaaagccaggatcaacaaagtagctgtacgcctgtacctgtcaaagtgtcaaacggg

SEQ ID NO: 12233 - DNA, 1500 bp, Zea mays
ccaagcgcaagagctcgaaagaacacaagcaaatctctctcactagtcactaaagctttgtgtggaatttgggagaggatttgatctcttgagtgtgtctagaattgaatgcctagctcttgtaagtggttggaagtgtgaaaacttggatgcaatgaatggtgggtggttgggggtatttatagccccaaccaccaaactagccgtttggtggggctgactgtcgtatggtgcaccggacagtccggtgtacaccggacagtccggtgaattatagcggagcgcctctggattttcccgaaggtgacgagtttgagttggagtcctctggtgcaccggacactgtccggtggcacaccggacagtccggtgcgccagaccagaggtgccttcggttgtccctttgctcttttgtcgaacccaatacttggtctttttattggctaagtgtgaacctttggcacctgtataacttatacactagagcaaactagttagtccaattatttgtgttgggcaattcaaccaccaaaattatttaggaactaggtgtaagcctaattccctttcaatctccccctttttggtgattgatgccaacacaaaccaaagcaaatatagaagtgcataattgaactagtttgcataatgtaagtgcaaaggttgcttggaattgagccaatataaatacttacaagaagtgcatggattgtttctttatttttaacatattggaccacatttgcaccacatgttttgtttttgcaaattcttttgtaaattcttttcaaagtccttttgcaagatagtcaaaggtaaatgaataagattttgagaagcattttcaagatttgaaattttctccttttgtttgaaatgcttttcctttgactaaacaaaactccccctcaaataaattctcctcttagtgttcaagagggttttaagatatctattttgaaaatactactttctccccctttagaacacaaagagataccaatttgaaatttaccaattgaaaatcattaattttaaaattagggtggtggtgcggtccttttgctttgggccaatactttctccccctttggcatgaatcgccaaaaacggatacttggaatgaaatataggcccttggctaactattttctcccctttggcaaataaaacatatgagtgaagattataccaaagacggagagtgatgcggagcgacggcgaaggatgagtagtagagtggagtggaagcctttgtcttcgccgaagactccaattccctttcaatatacctatgacttggtttgaaatacacttgaaaacacattagtcatagcatatataaaagagacatgatcaaaggtatacttaagagctatgtgtgcaaattagcaaaagaaattcctagaatcaagaatattgagctcatgcctaagtttggtaaaagtttgttcatcaagaggcttggtaaagatatcggctaattgatctttagtgtta

SEQ ID NO: 12234 - DNA, 1196 bp, Zea mays
ctgcagctagagaactacatacgcctctataaatgcaattctagaggcaggtcagttggaagacgagaactccggtcgcttaaaatcaattttgtagtagtgctaattaactctgtgttttatcaagtgctccctttgccttgcttctgatactagttgtctttttttttcagttttagcatgcaaagaaagcatggatagtatatatctaacaataatttagatcttgttttgaatgcactatctgctaatatataactaccaagctaatagcttataacttatattattagctgttttgctccaacaagtgagatatttattagttagatagtttgctaataagtagctggaatattagttagaccatttagatctaaaaacagataattagtaacagctaacttttagatttattactgactctattggatccaaagaggaccatagaacgagtgacggagcttaaaaatggctttaccatcccttagttaattcagaggaagagagttaggaaaaaaaaccaactcttactgcagtgacataggtagggtatgtatggatagtagactcacgtggaaaccgaagctagaaacaaagctcccaactgattctaaacaaacggacaacaacactggggccggcgtgaggaaacagcgcagtgcagcgttgccgccgtacaccagatgattttcgcctttttttgatttggcaaaaagaaatgaaataaatgcaattaaagcacaacggcatgcatatttacaaacatactatacgcatgccccccatccttctccctggtttggtttggttctatgaagttgacatccccgacccagggctgcaccgcaccgcaccccttgctgcgttgcgtccttctcagcggccctgtgttctgtgctgggcacctcacggccccagggaagggaagggacggcacgggacgggcccctcctcctcctccacctcctcctctctctctctctctgcccttctctctcctccacacttttaaatacaccaccagcccacggctgcccagctctctctgactctctctcgcgtcgggcacgcagtcgcacaagtagtgaactcaaacgggatctcctgctctgcctccctcgtcttcctctgcccgtgcgcgtttcagagcacgtacggagagggcgagcagcagcttgcggccgggcaccatc

SEQ ID NO: 12235 - DNA, 345 bp, Zea mays
tgtaattaaatataatctgaccgttgtctaacttatcacacaatgctcatgcatgacgacgacgtatatgcggtgcttatttcttgtgattgatgtatttatgaagaagaagaaaatgtcctcagctacaactaggaaaatttatatagtatacagctaattttggctgtgagttaatgctatccatatataatatggtatgaccgttgctctaagctcctctttggatctataaaaaccacctcgctctcctaccatttcatctcaacaccaaattaaagcggccattttccttttgtttgcctagcctagggctagggtattggtctagctagctagggtgcc

SEQ ID NO: 12236 - DNA, 1500 bp, Zea mays
tatgtcaaccttgttcattgggctttccataatgatattgctgtgttgcatctctaaaattccaacagagacactacctgcactataataatatcagcgaccatttggaagctggtaaaatggccgttgttagtaatatgtatttaatcaattgagggtttgtaaatgaaaaggggtttataactacattgaggttggctattacttcctacttataacgctaaaccgacaccaaattacaatttgatacttctaaaaaaaaattctattgacccccacaaaataactttggaagttttgtgtatcctgtctgtgtacatatcgattggtttgcgtgtgattcttatagtgatttttcttgctgtaaacagcagtcaattgtgacagtactttatgtctcttccacttgcaagttgaacgtgtcttttctacttgcttgtgtgctaattgcattcagctttctttgacaggtccctgaagtaggagaaatgccatatatgcggctgaaattttgctgcggagaggaagaggaagtaggaagaacctgaaataccttaattgtccattcttttttgattttctgatcgttgccatcacaattttgacggctccgaaaaataccattarcactcacctattctgagaattgagatacgctattataactcttaggttctcagaaatacgccattctatgcacttcagatatgctattatatttctgtattgcggagtattgcctagatgtcatcttctttctcctcttcccatcgtcaaaatcatccagagctgctacgacctcgggccccttcttttttttgttttcttgagcgaaacagatcctcactctccccgtgtggtggatttggcataccaaattatttcgatattttttgtagagagccaacagaagttcctcattcctgttccttcactacgtaacaaatttttattacgaaacccgttgaattggaccagaaaaagtaggcaattgaactgcagtttgtactaatctgaccaagtctgtctgattgtaactatctgcattctctaatttttatcatttgttagtgtatttttgaactaaaacgcgaaaaaataaaaatagaacgaaaagagtacgtccgttccaaccaaaccgtgacagcgcacccgatcagcgtttcgtttttgctcttcctcggcaacattatttcgttccaaaagagttcacatggcaattgtgtaattaacggacggtctggtaccttgtgagttgtgagtctgtgagactgtgaccttgtcaagacaagaaaccaggtgctccgctctcaataatgcgcaggccatcctcggcatgcgacgcggggcccgtatgacccagccgtcccagcggccggacggcgacaccaaccacgccccgttccgttgaacagcgtcgagtcgtcgccccatatcaaacgcccacgcagcgccggggatggagcgcggccggcaccagatgagagctgcctcccacac

SEQ ID NO: 12237 - DNA, 256 bp, Zea mays
ggtaagatcattacataagggcagacccagggccagaggctcccacatgagtgtggcctggggaagggataaactgaaccaagtatccccccgcaattgcggagaggctgcttcgaacccgtgacctggtgattcagtgagacagctctcaccactgcaccaggcctgcccactaagatcattacataaatgttagcaaatatcttatgttatattttcccgagtatatcctaacaacatcttccacagcgttttt

SEQ ID NO: 12238 - DNA, 1418 bp, Zea mays
catttccttctgtaagcgggtatatctatatcttaacccaccagtttaaatttgcaaaactcatccaattaaattacctctacccataaacttctccaaatccactaaataaattacacccacacataacacaacctcaaaattaacaggttcagatcgctaaataattctcatattttttttactaacttcaatcaaatgatcaatattatttaaatcagcattccttcttcgttcctcacacatacaataatctcttgccatcctcttctacgacctcgtcaccccctcccactcacttgcccctccctcgctctttgtaggactgttgcattaggtatccgcagcggttccctttaaaattcccctcctatatcacttttttgcgtcatattatcaatatttcatcccatacttttttgtctcggttccccttaaattcttcccctataccccactacaaccataaaatgtcattttctagatatatttttatctactattaatttttcttctactaataattggaggtggaccgacatcaacagtgattaggggcagccgcacgccacagctgaagggagagagaagagcacgcacgagtagagtacgccgtagagggccacgtkgcacccgtccgggtgcctctgcgcccgccatgcaaggggagggggcgagtgagcggctggcgttgcggttagtcttagactatcttcagtagcttatttatctctatacttctatttaaactctactattaatagtgtaggaaatcgaaaaacaacgttcggataacctatcgataaactactaggcacggtcttaatatggacgtgtagactagtacgtataatatatatcccaaatatagtaggaggcactgccgactgacgagttcatcctgaattcctgatgactcctcgagcgccgctgttgtataaatgctttccaactgcaaagtaggcaatcagaaggagcatataaaaaatgcgagctgctgccgatcataatatcatggacaggaagaagccaaaagtaatctattcagtgtactcggtgctcattgaccaaactccaaatgaatcaatgtcgcctcccctgcttcaggtttatcttcgcagccacgagtggcatgggcacacgacaatgctgcgctctcactcgctggtacggagtaggctgcggtagctcacagggccagcggccaccccaccatttcaatggtcagtggacaaataaatattccaggctcttcttgtctgctcctgctcgtccgtcgtccctcactgattcgatcactagccaccgctccaagaatccactagtccttatcttttaaatccatcgacttttaaagaacccattccacgcaagaatccgatcttgtaactacagaccacccaccaccgattgggaac

SEQ ID NO: 12239 - DNA, 1013 bp, Zea mays
tttcaaggaccgtgtccaagcaaaggacgcccacccatagctgcattgagagctagccaatgaacgtgataaagcgtgacctacagcgtaagcgtcagctcctcaacatcagtttcggcggccacaacatcatccgccacacgaaatcgaggcctgcaagctccaacgccaccgtgaagccgaacaccagctcctccaaaaggagtgaaaatgagcaccagctcctccaaaagcagcacatgcctactggttcctcttcgagctccatatgtratgtctccgtactggtttctcctcgagctccaactccatgcgtccgtcatgaagcagcaaacggcggagcccgggcacgtgcccaggctcgccaggctgtggctccggcactggctccacttaattcctaccaggagctaattgatataggcatatagcgcaacttgacattgttctcagattctcatgggraaattggttttgagagcggtactagacatgccttcagtgtacgtagattttcataaagtggttcttctattgattcttttctgattttatatcatgctttactcttgaatggatgaactgcactgttgataaactggcctttttcatggactgatatgaaactggaaggggtgtacaaatatcaacataattttttactgatgtatagaaatttaccagccatttgtgtttcatggctttcgttggtgttttttccagatattcacattagtttatactgtgaatatggcagttattgttattgcttcatcttttttttaatgtttttgttcattgtcatagactcatagtatggtgtgtgtttgattgtttctggtttgctgtgtgaattttacccttttttgtgtgtaaagggaaatgaattacattcattgatgtgaagaagtttgtgttgcctttgctttcagtcaaaaaaagaatgctactcctaaccttgagagacgtttgaactgcaaaccttttctgggagctatcattatactatcgca

SEQ ID NO: 12240 - DNA, 512 bp, Zea mays
ctactccaacgcttcatgcacgaaggaagagcagacagaaaagaagagagaaaattaaatgaatactccataggagaaaagagaagaaaaaaatagacaactagtcggtcgatatcgataacaagcatgcaagcgcagggagaaagaaggggcagtatacctaccgcaaagagcgcaaggtgtcgctgtcacccacagacgcagctccacgccatggctgagtcactcccgtgtcctagcaaatccggatcccccggctagctccggcttttcttctccgtgccgcgtcacccacagctgttgcaagctaccttgccggctgacagccggggccagcgccaccccggacctccagctataaatgccgtgcgaattttgcctccagaggaaccaaagccgccaccgttgccgtagccgtgttcttggactctgttacgtgctgccattttgccaaggctagccccctcctcctcttcttcctcttcttcttttcgcgacgatcagagaagaag

SEQ ID NO: 12241 - DNA, 369 bp, Zea mays
aattagaatgaagtatgattttaataaatatatggatattttcgtgactctatatggactatttcgtgtctgccttaaacagtacgtgttcgtacgtatccatggcctacgattttagcccaaatctagtccgatattacatatttttgtaccgggccgtgttttttttttctgcctcggatcggaatgtacacctacactctcgatacgctcccacaaccagtcagccaccatctgctccgcatcctcctccggcgcccatggcggaggaaaccctcgcgccctcgtcctcgtactcggtctcgtcggcaaagccctaaaccctagtcgacctccatttcggaaccctagccttcccgcgccgccgcc

SEQ ID NO: 12242 - DNA, 366 bp, Zea mays
tctgaaatcttagccgtgcgctctgaaatctacggcactcgcgccttcttttcctcctcggcgatgcccaggcggcgccgccagcttaccgcggtggcgcgtcgccggcacacggccactacgcccaatagcgccccgaatcgatcaccaagaggtcctatacaaagcggatgaccgtacgaactggatgggtagcgacataccgacgtacgaagtcccgacgatgccgaccgcgacgcggtgcggttcctcggaggagtattgcttgggtgagcaattcctagcaatcctcgtgcccgcccgcttgcacagacacgatctgagaggtcccgcgaactccaccggacccaggacggggctcgggcg

SEQ ID NO: 12243 - DNA, 532 bp, Zea mays
ctgaatcactacttcgcggggtcagccatcaacgcgtcagcagcaactagcaaggcgccaagcggcccaggactcaggccagctccaagcgaacagcctacgtacggctctatacctctcgccctctgagtctcgcgcggtcagtcggtctctctctctcactctctcttgtctccaagtttgtaaccctagccgccaagcttgaagctccagccgtgctcgtgtagggctgcaggccatccgagctccggcttccggcatccaccagacgtccttagaatacggtgcagcgagcagcaagtcgccgagcagccgagccaccgccgagcagccgagccgccgccgagcgccgagtcttctatggtaaattaaacaggctcggataaattagtgtttcaatttagagttttggacaggatttgaaaagattaatcacgctcacggctcacgcacttcaaaccctaacctgacggaggtgtttgcttctcggtggaagtttgcttctccggtgaaaggtgtttgctaggggacc

SEQ ID NO: 12244 - DNA, 704 bp, Zea mays
ccgaaggtcctcaaaaacatgatttaataatgtttctggagtagtaatacatgaaaaggcatcttcggattcgaatcagagccataatgggaaaagcacaaagaacacgaaggttgatgcagcgccgaagctatgtgcaagggaacttcggcatgatagcagaaaaggaaaccgacttaaaaggaaaaaggctatttagaactcgatggatcactatagagtcattagtacatgtaaagggcatgggtgtaattttacatgggatgcgtcccgtgcctataaatagataaacagttctcccgtactgttcacgctgacttggcatttgcttttgcatcacgcttgtatctttgctgtctatcaagtcaaaggtatcaaatgtaattcaatattgttttatttctccatgataatacaatgaagatgagttgataatgttacacgactgtttatgttatcttttgtattcgtttccttctgttaccttcataccttcgatgttcgaaggtatgtccttcatgaccttcgtctgaagatcattatgtcctaagggaaataatgtttcgaaggacgaagggcgttaatatttaacattttgtgttgccttgttcttaattcatagcatttgagaacaagtccccaacattggcgcccacctccggtgaactcttttcgaccaccttcggcaagcattgaccttcgtc

SEQ ID NO: 12245 - DNA, 1500 bp, Zea mays
gtttatgtgcttgtttatggaaactggattctcggtttcttaaaaccaagaagctagcctcccctagctaaaactaatttatagaaattgagatggttacaaacacgattaaccagttgtttttataaaccaatttctggaaattagagatagaatctggcttcttaaaaactaggttgcttaaggacaggaccttatatcagtagagaaatggtagaatgtgtagtctagaaaaatttatgcatatttctatggttgttgaattattttctataatagattatattggtaagacaaaaatatgtggaatatttagttaattgagcacgtaggtacataagtaagacacaaatttagcgtatttacattgcttagatacgcgtaatctaaaagacatatttttttgattatgaaaacaaaaagttccccaccttttgtaatttcttgcatacggtttcgcaaaacgaaaaaaataacaaacatcgaccataaacattctttgaaaaagaacatatatccatgaatcgagctccctttaatctggcgctagatctgcatccgcggcttgcaaagataaatggcacatttagtgtgttattttgcaatacctttcatagtagatatccttaaatgcagttttaggcatgtttgggtaattaaataacatttttaggaggagttttagatttacctttctttcgtgatgactgatgacagacgtggggaattcaaatgcaactctagcgaaagttcatatatttttcataaatagctgaggctggggtaattattttttttgtagaaaaatagaataggtggaatggttggggaaggcgtaggcgctcgtggacgacgcccgataaaagacaagaggcggaattgccatgaattcgaggtagctaagtaaggcgcatatatatgccaaaaaattctactgtcactttccaatttcaatgcgctgccaaacaagccatcctggaaactgacttgaattcagcccaattctgtagatccaaacagggccggcgtcagtgcctcaggtgagagagcagcagacgatgcaaagagccaaaactgcaagcagacgcagccgaagccgaagccgaagcccaagcccaaaactgttttgtctttgcccagaaccgcgacgagcctaaactgcgcttcctcctatctacaagtccctggcacatcacgcatagtccaaccatggcgcgcaggcgataaggcgcgccacggggacgcgacatgtggtggcggacgcgatcaggatagggccaggctggccgggcgcggccacgggagaacggtggccactcgtcccacatccgcttcgtcctgtcctgtactgcgtcctgcccccaacgagagccggagccggccatcccgtcgcacactctccccctctatatatgccgtcggtgtgggggagcctactacaggacgacccaagcaagcaagcaagcagcgagtacatacatactaggcagccaggcagcc

SEQ ID NO: 12246 - DNA, 531 bp, Zea mays
actaggcttaggaagagaatgatataatatgtctcttgtctatcttagatttcagcttctagtcaaatagtagtccatgtatatgttagcacattatcttatcaactatcttatcttggttagcatctactttagtagttagaatatgctgagcatttcctagtttccaagttttctacttctatatgtatccaatcccgccatggtttatggtgtggcttaatgaaatagaaaatttgccccaaaacctgtctatctctaaaaaatggtataggagcccagttcttcccagaatttttatctatccctgcgtggcgccatggccagccctctctctcctaccacgagtccacaactccagcgtacggcgccgacaggcggctgcacgcgactggcgtgcagcagccgcggcagcagcgaacgcgcaggaggaggagcagacggcacacaacacggctgcggctcgggaggagcgcatcacagcagcagaggctgcagtggcacgcgccggccgagacatcccgccaggcc

SEQ ID NO: 12247 - DNA, 577 bp, Zea mays
cgtccccgtccccgtcccagactgattaatattaatataattccgatccatgattgatgaatgttcaccgcgcattgctcctcgtggcctgaagaacagcggaaggggagaaaatgttgatgtggaccgaccgatgcaggtcgacgaggtctatgcatacgtagtttgagcacgcgcttgcttgtttgatcactaaacgacggggcctagacgcctagtggccgggctgatgctatgcaggccgagtcgccactgcttggatcgggtctatcattagactcggcacgatacactctagtaaaatattattatatatccaatttcccaactgacactcgctaccagcgattgtttacatagagatgtacatgtataaatattagaaactcactttcatcagacccatcaccactcctcgctcgatcgttctcctgtttcatctcagctccgagccttattagatagctgacaagctcatcatctgcgaagttaattgctgccgtcgggaaccgggatcaatcgagagtgatcatcggtcgatagcaaccgtgagttcgtgtcgtgaccgagagagagc

SEQ ID NO: 12248 - DNA, 528 bp, Zea mays
cctgaggttgaggataagcatattttcagtattgctccaaatggtgcgtactcatccaaatctgcatatgaaggtttgttcctaagatctatggcatttggacatcataaaagaatttggaagtcttgggccttgccaaaatgtcgtttttcatatggttggttgcccagaagcggtgttggacagctgataggttggcaaaacgaggcctaaatcacccggagaagtgtcttttatgtgaccaagaggaagaaactttggcccaccttcttgtgaaatgttccttctcaagagaattctagtaccttctattcaggaaatttggtcttcattctcttacaccacagccggctgcaaactccttcctgggttggtgggaagtggcagggggagcagtctatggtcttaccaaaaaaaggcattgactctctcatcaatttgggagcttggactttatggaatcatcagaataaatgtgtttttgatggctgcaatccaagtatatcgagctgctgatgaggaaagaag

SEQ ID NO: 12249 - DNA, 1054 bp, Zea mays
aggctgagccgtggagaattcgccgtgacagagaaaggttttgcttttctggtggtggttgcgtggctaggctagtcttttctcctagcgaggaaaacctgacatgtatgtgctggacacttgtacggttgtgccatgtatcgttcgatggctgcttttgactgctggtaagattatccattggcatcgatctgtgacttgttccgttgttcgacaatcagttttcaattcagcagcactctggcttggccctttccagctctggacggttcttgcgtctttcatgagcatttgccagtaaagaagtcgctggtcagtaaagaattgccagtagtggtactggcttgagatctcatccctgctgaagtctccacttgtatattgtatacagaattgcagcaaaacaattggccgtctgcgtctccagcacctgcgcagcgaagtagatgacgtttcttggccgctaatgtcgcctccaatcatttttgcattacaaaatggtggtcaattaatcctacgcagaacaaaggcaacgaggaggccgctgattgccgcgctcggcgttccaagcgcaggaggtggctggccagtgtgcccaaggcgcgtcatgcctgccgcctttgcccgcctctgatgctcgcaaagggccagcattctctcgtccactcaacgacagcgagccctatcccctcagcaaaagccagatgcctgttgccgtcgcggccactggatgccaagtactttttatatacgccgtccgcgcccacgacccccgagacccgcctcccctcgtcgtctcgtctcgcctcgcgtcgtctgcgctcgcggctcgtcacaggtgaggtgagtgagtccgccgggagcgagcaagagcaatgctcggtgccgcactactctgtctgcattctctggcctcccgcgtgccggcgtgcgtggtttcggcctttcgggcgctgctggttgtggttgacgcgccggttgctttgctgaaggtctcggcgggagaggggcggcggccggtccgtgtccgtgtccgtcgacggttggttcggga

SEQ ID NO: 12250 - DNA, 804 bp, Zea mays
taatatgaagtcaaccgccaaagttcgaacactcatatgtgcaccattttacttttttgcattgagcgcaaagggaaaatgtgaccggggttgacatttgaaactagtgtttttatatatagtagagaagtacagaagaataatctgatcaacttagaaatacaattatacactctcttatgtaagattaaaccttgcatatagttatagagatgctgacgctacacggtgtacagcacttacacgtgacttctataattgaaggatgcatcaacacattgacgttatctacccgtatcaatcgagtagagtatccgttagttttcagatttgagggttattaaattgcatctctaatctttactgtcagccgagacgttgagcggtagacaaatcacaaaagagagctgtgcatcgtgcacgggtggtggaccggggggcatccgtgcctgtacacgacgacgtgcgcgtgcgccaagaagatatccttcatcatgggctcatggcaggtggggtcacctgttgtctgaaccgtcgcgataaaagacgcctaacagtctaccattcgtatgtttgatcgatcgattgcaatttgcaaagcacggcgagcggaggccagatcaaaaagtagcacggcgcagcgagccagcgatataccacatgacacatgtccacacccctctgcgttcggtcaccaaacagtcagcgcagggcagggcagcctgaaagaaagcggcggcggcagcaggtcactggctcactgctctgtcctctcgtctccagagttcagaccaccgcatcgcc

SEQ ID NO: 12251 - DNA, 1500 bp, Zea mays
ttttgtacaagaatacatatatatgagagactcagtacaactcattcagagaattatggaaactgctgcatgcatgggcaacaatataatttatgtagtgcataagaacgaacttagaagctaacattttcttcataaacaattcatgtagtgcataagaaatattcacatgcatgatcaccgatgcttaggatacatgcatgtgggactaaaccagcagctagggttggggtgggggccggggaaggtgtggtcatgcaccccaccacgcgttcatttctctttaacactgaatttggatgcatattttctttttcatgaagaactgcatgcatcgccgttcctcctaggttggttacatttctttttcgtaggatacatgcgtgtcgctgatgtcacgtaatcatattagttaagactgatgatggaataagagggctggtgcgtgtatggtatttatataaaaacaaacaaacaaacacatttttagcatatgcttcccagaaaatcgtatgctcttttccatcaaaacaggaactacttttctccatatgcatgtatatgcatgaactatctttattctgtgatagccgactgatatatatgaagaaaaaaaaatgttctgatcagacttgcttagcatcataagactaattaaggtatccgatcagacttgcgaagtgaccagctggtatcagctagcagggacagatagtggagttgccatggtgacgcctcaacgtacgtacacgacacttcacttgctcccatctctcctaccgctcttgttctgaaatactctccctctgaggcctatgggctatggctatggctgcctttgttcgcacagccgctagcgtgaggggtttccttctccctccaacccgcatcgttcaccaatcccagggagatcgattctacaacacgatcatggcatgcacagccttaaagtaacactataattcttcatttgtagcactaagcacacgctatgaattaatatatataatacatttacacacacatcattttcttaatttgtttcctctctctctctctctctctctctctctctctctctctctcatgtcgactgagcaagcaagtactatttcatctctcttagccacaggcttcgtgcaggctcgagaccaaagggaaagtgaggccacgcactatcatctctgtctctccccctagctctctattggattggcttgctcccccaataggagaaaagcgaggattcagaatcctcctcttcctcctccccttccacgccatctctctcttcagctagatagcttctcgattcaccttctttccttgcactcgtctctagcagccgtggtgcagctaggtgattgagtatatacgagatgcagcgcacgaccgatagggagctgtagctagagatcgatcgagacatgatacgtaccaccacacggtcgcggccagcagcaccagcaagaggaggaggaggaggaggctgtcgccgcc

SEQ ID NO: 12252 - DNA, 1500 bp, Zea mays
tactagcatataaatagctgtgggtttattcaaatcaccaaagctggaatagctcagttggttagagcgtgtggctgttaaccacaaggtcggaggttcaagccctccttctagcgttgtttttaacaaccttattgcttcaacgaatttcatcataaattgaaaaggacgagctctcgtgctaagtcaaaagcttaaacctagacattttaactacataataatcattacttgaatgggttttagaataaattaaaagaactggtatttttaattacacaacatttattacttcaatgaaagaaacgaaccgctacatacataatyagtggcggataggtaattccataaayttctctaactccacaccacatggaactagactgctgtaaaacttatactatccagaaactatttgaactgtgtttgaactttgaagagctaaccaatctagttgactttgtaaagcaaagcgcttcaagaggccaactgaaagagtccaagttaaatagacatgaataaactacaagacatgcatgtacatacacaaagtataagcaaagcgcttgaattgatataatttttagtataagtactccgtagaacggtacggattggtgaacaaggctaaataaaaaaaaagtgtcgatacacatcgaagtggccagaagatgggccattctgattgcgcagtagtctgggaccctcccggcccacacacactacgcctttttttttgagagtgagagagagaggacacgcactgcgctttagggggcgtttggttacttgtatgggtgagcctggctcgtatctagtgagcctggctcagactggactggctgagtgcatgcagtatagcgtgtttggttgtgtgtatgtggccagtctggttcacaagagatgttgtttggttgcttgcatgagtacatggtgcatgagttaaaaaaattgttaaataaattaaaaaatctattaatagacactaattatatggtaaattgcttaatagatactaattacatgttaatatacactaattatatattaatcttaatcacgtaatttttttatttgaaatatatatagtatgagtggtctagtttcgttcgcaaaaatgtcaggaacgcggatatgaaatcggttcggtgattaaatcttttaattagacgatataatgaaaaaaccaattaaaaacgtgtctcgatatgcgtgcacgagtaaagagctggctgagcggagcctggccgcgcgcgtgcggccgcgcgatgcgtttctgccgggcctggctcgcggcgctttaagggcctgtttggttcgtggctaactgcgccacactttatctaaggttaggcgttcgaattgaagaactaaccttagacagaaaagttaggcaaagtatggcaagttaggcagtgaaccaaacagaccttaagttccgtgctagcctgtctcgtgcgatacaacgaaccaaacaaacactactttttgcatgtgtag

SEQ ID NO: 12253 - DNA, 49 bp, Zea mays
ttgatactattttttgtacgggatgagtcctcttcccttgtcctgacaa

SEQ ID NO: 12254 - DNA, 624 bp, Zea mays
gtggagaaggatctccaggttgagaaaatggctaaccacatccacgagctcgaggatcaagtggaagccaaggataacaccattgaggttctggaagaccactccagaacacccagcagcagctcgaggaggcaaaccagcacttggatctgcaccaacaggagacactacaccaaaatagtaaacttcctagagcctaaaccctaggaagttaggcctaaactctaggaagttagcgaaactctcagaagttaagccatcccgtcggaagtttagctctcgataattttttgtcggaagttagcttaacttcctagagggatctaggaagttagctaacttccgacaaaaaattttcgagagccaaacttccgacgggatggctccacttccgagagtttagctaactgcctagagtttgggcctaacttcctagggtttaggctctaggaagtttactattttggtgtagtgaaataagtcaccatcacaagtcttagtaaaaagagttggatcagctttcccaaccttgaaagcattagcaattaaaaagcctctaaggcattcataccatgctcttggggcttgcttaagtccatagagcgccttagagagcttacacac

SEQ ID NO: 12255 - DNA, 310 bp, Zea mays
acatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcgaactgctagtggtgcaatctaaaatgtagacgctggtgtttacatgaagcaatccccatcagcatgcaccggtgagattccaccggtgccaatccccatccatcctacctactactagtcatagagagcggggcagggtacccctgtctcctg

SEQ ID NO: 12256 - DNA, 558 bp, Zea mays
cgtacagctgtggggcatatattagcaagagttcaagactttttggtttaaagcaccatttcttcggcgcatcccagcatttgcacgcttgatcatagaaaatcttacaccgtttcctccaatccacgctgtatcagacctaaaaatgcttaacagcctcgatcaatctgtatagcgcccgatagggcgctgctgattctagtatcatcaatccatgatagcgcatccaactaagtcctcaattgaaacttcaccttacgtgagccgttggatctaaacccaacggcaggaattcgaatgcgctagggctatgaaaacatgcgacacggaatagtagaaactcaccccaagcagcaagcacccgagcggccagctccagccccaccagagaaatacggcgtaaacgccgccggggaccaacccaggcgaccggggtgcctagctcgccgtttcttttcgccttctcctcgcaatttcttaggatcaacgccctactacacgacgggggttttccccttcggccgccactccgtcctttcgcagcctgccgccggcgcc

SEQ ID NO: 12257 - DNA, 1500 bp, Zea mays
tttcagctagcagccgagctagccaaacagcctgacaagcagcagtagcagctgatatatattcagcctcacagcttgataatgccactaccttttgctttgttgattgccaactaattggactactgctaaggaagaaaatgactccagttgtgctcttcctctcatccaaatcaccggcaagatcactatcactggagcccactaattcgattttcctttcacctttcctgggatagaagaggccccaactccttgttccagacttccagctatgtatctgagaatctgcttcacagctgcaaaatgctccatgtggggctcctccataaatctactcacatacccaactgaaaaagccaaatcaggtcgggtattgaccagatacctcaattttcccaccaagctcctgtattctgttgcatctacgcaggggctgtcatccttcctgctcagcttcagctttgcctgcattggtacatcacacgagttgcagtctgcaaaaccacttagatctagtatcttatttgcatacctctcttgagaaagggtaattcccagctcatcctgcttcacttcaatgcccaagtaatatgatagtaaaccaagatcactcatcttaaataccttggtcatttctgccttgaaagtctggatgctgctgctgctagtgcctgtgatcaccagatcatctacatagacacctacaactagtctctctgcaccttctcctcgacagtaaatagcatgctcagatggacatttagtgaaccccagaacacccattttttcatccagtttttgattccaggcacggggagcttgatgcaaaccataaagagctttgtgtagtcggtataccttgtgttcctgtccaggttgagcaaatccaggcgcttgctgcacatacacctcctcctggaggtcatcgttcaagaacgccgtcttgacgtccatgtgatggacttgccatccctcctgcgctgccaacgccagcagcagccgcaccgcttccaagcgagcgaccggtgcaaacacctcgtcgtagtcgattccttggcgctgagcgtagccttttgcgacaagtcgtgccttgtgccgtaccacggcaccgtgttcatctttcttgaccttgaatacccacttgagcccaatggctcgctgcccagatggcaactcagtgagtgtccaggtgtggttgtcctctatggcgcgcagttcctcctccatcgctcgtcgccagcacgggtcttgcccagcatgtgcaagcgacccaggctcctccgcactcactgcaaagagttgctcgttgtacagtacgcgcacggcgtacccaggtggcgacgcagctccggtgacgtcctccactgttcggaaccgcagtggtgcgttgtcgtcgtggtcggcgtccaggtcttcgtctaacgcagcaggtggtgtggcgaactgcacacccggagaagctactccggcctcccctggcgttcctggtggcgtcat

SEQ ID NO: 12258 - DNA, 640 bp, Zea mays
gcaagtctgatgaaattgtatttcccgaagtttgcttcgtgcctcagcacattttcatttaacaatgtattgccaaagatttgcttcgtatccaatctttttgtcgttgatgcgatatgatgtatgatgtaatgttatgtggaatgatatgatgatatgatgcaaaatgatggtgatgtcgaacacacgcacgcacgctcccacactgggacacacaagactttgcatccccttagggacgtctttggagtctttaagctctgcatccccctaggaacgattttggagcttcttcaccttatatttcggtggcatttaagctctgcatccccttaggaatgactttggagcttcttcacctcctatttcggtggtatttttgttagaaatatgccctagagataatcatagagatgagcatatttctttgtatccatgatatatatattgcttaattgaatatccatggaaggcaccttgtattgattagcaattatgtgaattgtttgtgagattctttacttatatggttattctaaatgatgtccctagtcagagtcgatgactagcacatgtattagttgatgactacatttcacaagtcatgaacatggagatgttaaactaataatgtgggcac

SEQ ID NO: 12259 - DNA, 365 bp, Zea mays
ggtaaataaacgctcctgggaaaaaaaacaaaaacacgaagaactccaccgtttcatcctctttccccaatccgttcaacgacggcttcagaaacccttcctccggcggccgccacaacgaagcctcgggcaccgcaaagcaaatcctatcctatcagtcgaatcgtgcgtctcgccgagcctcgatcctatccccgccacgccgatccctcgtcggtcgtccgaatctggtggactatctccatcgccgggcgtccatttttggccgggtgagccgggggtggggggtgggtgggtatttggtgccgtgagttgctgctcccgcccgtcgatgcttggttagcagaagagacggcggcggtacc

SEQ ID NO: 12260 - DNA, 886 bp, Zea mays
atgtaatgtaaaaatgataagtagaatcgattgtggtgagttccaatcggccgtacacttcatctatataagaagagggggtctggacccgttacaatttccgttatataaattgcccaatttactttctttatataaattgcccttctattaaaagcaaaaaattccgttatgtttatctctcaaacattcaatttgaaaacattgttttaatagacgtgatgtttttttattttaatgtgtctactggtcaatcgaatatttcttttgctcgggctgattcgttgacatcacttttcgtgttctctgtaaattttgccttatattgtgccccggcctccaggacgatggctggatgaattccaacctgcaagatcctgttctttcggtcagtaaactgatccaaagtccggatttgatatttgcccagcgggttccccaaaaatgcttcccgatttcacggaaatgaaacgaagccacagggaagcaggcaccgtcatgactcatgagtcttcacgtggtggggtgtgtggtgcccgtatcctgcgtcatcacgaggtgcctgctgcagcgtggtttttttagatgaagcaacaaggaagcacggtaccctcccttcgagaggctttgaccttgacgaataccagcccgatctccatcgggataccttcactgccaagttccccttacgagcgaggtgtggtctgccgcatcacgagaatgcccaccacggcgaaccttacagtacaaaacaatggaccaaccaagctagccagtgaggcagtgattactgtttataagaggagcaacactggcgcagatttcagcgatcgttcactctgctttctccagtttcacttgagagctagctgagactgagagcaaa

SEQ ID NO: 12261 - DNA, 207 bp, Zea mays
ggtaagcgcacgaaggggcgcgttcagagaagtcgatagctamcagttgtatatatataagcacgcctcgtcaggctcatttcgcactcatcagctcaagctagttaatcactctccatcctctcccgcttctgatcatatatatccattgcttcactacgcactaatataaaacaacaccggccgggacgaactcgattggcagcc

SEQ ID NO: 12262 - DNA, 1068 bp, Zea mays
gtggcctagtttaaaaagaaaatttttagaagtcctaattcacccccctcttaggcgttactgtttcttataagtgctaatatttcctattgaggtgaccttctaaggcccttctgatagtgagaataggtgtatttatggcattggcacaccgtaatgagggcttagtatagttcctctttcttttaatacatgaaagtacaaccgcactacctagtcatcgcgatagagattttactagtctcgggtaatgaacatgattgccttactagttatgtccttaaacactatcgtaagtctgtacagtggtagcgagtatacctggccctgatagcatctcagggggatggcgtcaccataagttcatctatcagaaaaacatgtatgacaagttacattcatgaatgttaggatcaattccacttggtatgatacatttggtaacaagtgtatccttttgtactttattgaattttatggtacactttatatgtgcatgtgtagctacatgattaatacacatacaatacaatgatctcgagtgctctacaacctatatcgtggcaacaacacgtttgtgaggtttataatttcatccatcatgcaaataaagaaacaattaattttatgtatgtcctatttcagtcaccttgtggggtagatgcatgtccgtgattttattgctgccatgtgccaaccctagcttattaatcaaaaaatttcaaatacaaaattacctacaacgaacatcacaatgcataaaaacgaactagccatatgtcatgcattgttacggtttctatatataacacaaatataacttggtttaataaatcacaaaaatgtgtgttctattggttaggtggaatgtggagcaaccgttaatttacgaacccgtatttgtgcataattttaccttgtttcttacaaagcgagaaggggaatggtgacatatgacgaccgtggaaccgtggaaactggtgcttttataatagagataatgaagtacaaaataatcagcatgttcataaatgtttatttcagcactatgaatagcaaaaatacaac

SEQ ID NO: 12263 - DNA, 1500 bp, Zea mays
tataaaataaaatgacaatatgcactaggtttgatcgggtttaaaaaaacccacgggttcacggttttgggtactctaggaacaaacccgtacccatgaaccatcgggtatgcatttatgcccattaacaaacctatgggtatgaaaattgactcaaacccgtaccctaagagcttgttcggttattttcaatccatgtggattggaggggattgatacggattgaaggggattttgacttactagggattgaaaccccctcaatctccctcaatccatatgggattgggggtataaccgaacaagctctaatggggtaaaaacccatcgggtttcgggtttcgggtacccattgccatctctagttaccgctcacgcgacgcgacgcacgggaaagcgtgcgcgtctcgccgccgaacacgagcaccgatgggacggggaccgcgaccgcgaccgcattacggtcaagaacgaaagctatatccgcaagcagagcacgtttgtaaccgtgcatgtttcacgtttgatgtatactaatgcaccgcacacgcgtatggcgtgtgtgctttcggcatggtctgcttgtcgagtgtttttttccacaggatgatgacgatgtgtcatatgcacacagacacacagtacagtacacctgacgtgactcgtgagcaagcgatcaccgttcgcgtcttgaccttcttagcatctccaagagaggacttaagccggatcctatattcaaatataggagttaagatctcgagataacttccaacaaagttgctgttttataaatttccatcaaatgaatatagcacccagtcaggggacctattcctatatgtttaatctcacggagttaactaactcgtgggtttaggagttgctgttggagttgagaaaaatttgttgatctaagttaatttgaatcaagtctaatttagtttttgaggccctaattatatgagttcctttcggagatgctctaccatatgataggagtactcgacaaatacattgggacgtcagattacgatgagttcagcccccttttttttccctcgaaaattcgctttcacatggtcccaagttcaccatgttacaacttccggtttctcttctggtccggtatgctccttccgatttctcttatgggctcatatgctcctgattggcccagccttatacagagaactgagagtaaggcccatctgatcagaccagcccatgctggcatgctccattagatcgtcccgctggccgcctggacgtacgcgcgcgcgcgcgcgacgccacacacctttcagtcgtgcagagtgttcttttttttttttgacgacctgcagttacagacaggagtacaggactagctccggcggcaaatatcaaccgccacgccacggccgagaaatatcccccatccacggctagtgtccgtgtcctcgcagctgcagttcactcccggtcctggtgacccacgcccgatcctgctcccggaca

SEQ ID NO: 12264 - DNA, 1500 bp, Zea mays
gctatttttagcaagtcatttttgtattagaactttactcaagatagaatgtggcaatttctgtattacataatggaacatttgcccttgtgagggatgatgggaactgatacacttcactggtccagctaatgaatgtagcatagaggttcctggtgttttaattgttcaaaggcttcagcagttgcttctcaccttggctactctaataaaaagggtaagtttgcccttgctttcttcttgaacacttattgtaattatagagtgcattgatttggagtgtctccctctttgatgtaggaactatgtgactcatctgttctggtgattggatatataatgaaaatattctgtgaggaagacttcgcaagggcaagttactttagagtttacagtgtaaatgaatattaacagctacttatgtattgtttaacaacatgaacatcacgctttttcatcttgcttacttacagagatgtggttctgtcacttatgtgaccgttgtcgtgtatggagacgtgtatggagacgaggacaagccagcgcttataatgtttacagagatgtggttctgtgactgttgtcgtgtactcaggctttatttcaacaggatttaaatatgagatgtagagtgattgatgtacatcacttcactaatcatgaaatctgtagaaggcgaaactactagccatatatgatatgcataatctgtgtggtaaacattatcaatatcacacaaattatttttaatgggttttgcattatcatagtgattgttgtcgttccgtttttatgtttcatacaaatttttttttactcccgtcgcaacgcacgggcactcacctagtacaagatgaaggagacgagcgagagtttgtcacgcggacggtatgaagacgcgtgacgcgctcgtgcttaggagtagagaagagacttttatttgtttataaacataaaaagaaaaaaaaatacttccggctccatccgccgggccttatttggcattgaccgggtaaacttgacaaacgtgggcctgtagtggccgtgcgggcggctcggcccataacgaaggcgttagggtttcccctcgcagttgccgtgcggccgtgcctcatatacacaatctttcgcgctcctaccggctaccgccgcggcttccttctctacccttccctcgcgccgccgccaccgcaagagtatctcaactccgcctcgagacctccccccctcgctggtctcagccatggtgagatctctctcgtccttgctctagcgcttgttgcatcttcgctgcgctgcagccatggatttggcctcgcccttacgaacccctgacgtgcggcggctcttgttttgtggttccaggtgaaatattcgacggagccgtccaaccccaccaagtgtaagcttctttaacaaaggtttccatgcgtatttctgcatctgcgggttttctgattcgcctgtggttctcttttattcgatgtagccgctaaggcc

SEQ ID NO: 12265 - DNA, 318 bp, Zea mays
ttgctctgggagatccacgccgacaaaaaaggaaaaaaaaaatctacgtatctaccacgtgtcacgtgctcccgttatattacgagaccgcgcaggccggacagctaccgtgcaacgtcggcagtcggcatcatcatgcttgactcgccgctcgcgttgcgcgccaaccaccctataaaacgttcggcgccgctagcgcccacggttcagtcgcccacctcgcttgcccggctccccctcctctcccggctcccgccacagaaaaagacacgaggagcgcgcgtgctccccggccccgcggcaggcagacacgcatcg

SEQ ID NO: 12266 - DNA, 1500 bp, Zea mays
gctgtgtgaatgcataacaccctacatcatgtgtggtgttgagtattagattgctttgagtttgcagattataggtagctgtggaagtgattgaaagagttcctatcaatccaatggtgggcaagagagagagagagggttttggtagggtaatctctgcagccttatatagctgactagagagatatcctatcttatagatcatttgagtctatcatcttctattgcgagtgtgcctactcttccgatgttcagttgcttttcctccgagtaggtcactacctggtcacgtctaagatgtgtcttagagtctcgccattcttctgcgacaaacacacatggataatgttcttgtgtcgtattcttcgagcttgtttccctcttggcatgttgtcttgtttcgcctgcatgcgtcccgataatacgcactgttgggtgacttaccgcgggcctattaggctacccatgcatggaacatatctgtgttgcaatgacccatggtatatccttctcccatagccgtcgctagatccacgacggaagtcgaaaactatttctcaccggcgtcgacgtcctttgacataggatctatcgaatggccttggtacggccgtcgcgatgcagaatggcgagttactggcgagacagctagggctgagtgtaaatagcgacatcatagacagccacatagtttatatggtggccttggatccacaactctagttattgaaagtctagtgctcctaatatatgatctcttgtatataacattttatagtaattaagctgcttgcaatggagtaaatgatacggcagcagcgtgcgtgcacacgtattgtgtcccgttgcgagtaaatgcggcgcacggcgggtgggccatgcgtgtttaattaatttgatttgaatggatccatgctgtttcattgcgttcatgcagatactcctgcccagttccggttactttcttttttttctatgaagacgtattctttatttaaattaaatcgatattatacgtactagtaagaatgcttgaatattttagtttctataataattgtatatatcactagtagttatgtcgtttaattaacgacgttgatgttaagcgagcgcgatatagctagactacactaaattaagttacacagtaatagtgcacgcaacgcaatttgggtcatgcatggccggtggtacggtgaggaatgaagaagatgcatgcatggtacgttgtattgccatcaaggcagctgcatgcagtagtgtgtacgcgcctcagctcgcgctgcgttcaattcgtggctccgggtcacgacgggcgacaggtaagtcatgcagatgcaccttccagtcgatcaatgacctgcttgctctctgccgtctggtcatgcatgcatgtgtgtatatatatgcatggtgtccgcgccggctatagctgtgctggatgatacatgcatcagggggcggccggccaaccagtagtcgtcgatcgatcacatt

SEQ ID NO: 12267 - DNA, 1436 bp, Zea mays
ttttaattgagaatatagaatggaaggagatcaggattcaggataatattagctattgtcgaatgcgttcagttcatgttgtgtgctgccattctgaagaaatcgttcatggtgtggtggacttgtgatgctggtggagagggttcaggataatcttcccagagagacgacaatgggtcaaccgctcaagaaccccttccccgcttccacagcagcgcccgtgaccgtgatccagcacagcgacccgccgtggcgccgagggaatcgtcgctatctatccaccattgttgcagtcggtggtgtgagcgcgtacgtacgcggagccgggagaacattcatctccgcttcccaacaccttattctagttctagccgacggcaacctacggcagtgaggctgtccaccattgtcgccgggaacaatcgccgcgaaatgtgggtataccgtatgtgtatgatagcgtagaagccgtagatgaaccacgggtgcgtggatgtacttgactgcgtgggagttgctgctgcgcacgcacctgctgtctggtagtagatagattgattaacaccggaggcgtttctcctgtcgatcacttgtgattggattccttagctactaccctgcctacttgctgttagcactgttgatcagcagcaagttgtttgctgttgttcttgccgagcttggagccatctgaactgcgggattatcttatcgtgccactcgtcctaaccctcttcagctacatccattagcttgccaccaaaagggcgttgcaaactagctttgcgatcaataatgtgacaaataagcctggagcgcgcccagttagttttttttcggattagtaaaatccgcggcaactgcaccggctccctgacaaaaagcacacatgcctgaacaaacaaactgccactgccacggcctcacgggccgattaaataggagcggtgatgtgtcctggtctcctcctatttgttctttccagacaagtcttaacacgcacagcagccagacacgaatgcaattaagcttccctttttgctctacaaactttgcgctgcagagcctagagcgaataatgagttgagagaagccggagccaaacttgcttttgttttcttcgtaggaagcattcgtgagtcacccaacaacaatgaacaatctttgcacgggacacatgcattgcgcgccccgcctcaacttgcatcctcaccacatcacagtaacctatgctactgtgagcttgtgactgtgcatggtcatgggctcatggtcatggcttcccgggccgctgaggcgacaggcaaatctccccaccttctgatccctcccggctctcgcctccccagattttatactccacggcctccgttgcacctcccattttttcctttccgtttcgtaccttcttcttcctgctcctcctcccgtgagcc

SEQ ID NO: 12268 - DNA, 425 bp, Zea mays
gcacgtgcagcgcgcatgacgaggggggacgggaaaagcggggtgcgcctgacgtctgggccacctttgccagtggccgcacggaaagccaggaagattctcgccaacccggccggcgctggcgcactgcgcactgccgcactggtcagtcagtcagtactactactggggtactctcggtctcggctgcacgcacgtacgggcagtcgcccaggccccagctagtagctagggcaccgcgcacgcggcacgccccggcccccgctctatttatgccgctagctagcgacaccgaccaggtcacttcattcccttgtcactagctagatcgactgactggagaggagctatcgtctactacctctgggcgagctgcgtgtcctgtcgtccttctcgctcctgtggtcgccgcgcgcggcggtgcg

SEQ ID NO: 12269 - DNA, 425 bp, Zea mays
agtgccgggccgcccatttggccatctataaatctataaatgtagaggccgcgcgcggcggcgccttgcacttttggattcttctgccgcctccagtttcttcgcggacgcggcttcttgcaaagggtgggcactgggcagcaagcagaagcaccgaccccgcgacgggcgccacacaagctcaggctcgcactcggccagtcgcagtccatccattcccccgcggcgccgaatccgccttcccccacctctccaaaaccactggcgcccaacccaggcaggagcagcccactgctctctccgtccagtctccgcttataaaaaaacgcccacccccaccccctccctctccaacaacttgggcgcgcgcgcggccgggtagcaaaagctcgcgatctgtgcgcccaccaccgggaggagcgaag

SEQ ID NO: 12270 - DNA, 202 bp, Zea mays
gtccccccccccaatgggtgtgggcaagggacggcttggtacgctgagtgttttagccggttgcctctgagtagtaatgcgatgggacggctagtgtaatcatatcttttgcactgttgactggagtcccaatgggtgtagtgttgcatgaaacggcgtccgccgtctgacgtgtcttcgggtgggtggaagtgcttattga

SEQ ID NO: 12271 - DNA, 660 bp, Zea mays
ctttttagtcgacctgcagcccctgtgcattggagtagcaggggcgagagtggaggcgagaggtgacgtgtttttattctagaggaaggctctgcactggactcacctaagaaaacccctcgatcgcccctgacaaaagaaataaattacacatctgcccctcagaatccaccaccaaaccgagatgtgtccatatttactcgcaacaatatcttctctttcttctgtaaaaatataaaagacccgtctccgtctcgggggagcaggagagggggagaggccaagaacccagccgcgaagccaagcccatctgatccggcccctgctgccctgccccagctcgtctctcaggtcgccttgccgttgccggttccgcgcccgggcccggctcagagtcgcgagctcgtctcgcagatccggcttcgcttgcttgaattctgttctttgggagcaaagaggtaggtagttttggccgggaaggccggggctcttggctgcttcctggtgttcttgctgggtggttactcgaccgaaatgtgacctcccgtgcttcgcaggtgctggccggtggcgtggcttggtgctctggggccggcgagtttttttttttgcgtccgctcgctctgcctgtagtcttcttgctgcggcggcggggtggag

SEQ ID NO: 12272 - DNA, 1500 bp, Zea mays
tgcactagacagcacccctacacgatgaagtggtggcggcactgcattctgttcctttattctctttggtgacttgttgccatagcattccaaagaagagaataaacagatataatagtaaatcagctggtatcacagtttgaggagagattctaggagaaactgaacttaaagcttcttttttccttaacaggaaaagggggcagctaaatgagagttgcctaaacaaataaatctgcaaagacaaacatttgagggctgagaggcttccatgaggacagtgcagcatcttgtgatccagatcatgaaaaggcaatattagaaaacaggagaataagaatataggaaatttaagtaaacatcagatcaagcatgccaaatggaattgatagtttcaccgaaaactaaattctaaagaaccatattccttttttcccatttagatccagaaaagccacacttcctaattatacttcttttcatctagatgtttatttttttcacaataatgcatcttaatgtgttcaccagaaaccagacactactacaacttttccggaatagtccatatactttttcctttaaaaaagcgcagagctgatacacaaattcaatatggtaattaagcatcatattctgcagagcgcaaaccgcaaaggcttccacgtcagcaatttttgtctccaagcaaatgaaaaaaatccctttattttccaatgtatctccacaaactgatactaactaacttgccacaaacagctacatagatacgtcattttaagaaaaaaaaacggacaacaataaggtgcttgaagcgtgctctccagaaatctgatggtaacgattttatgtaaaagctcactttttttctatttcggaagggcacggagacaatggcacatgacaatttttgataacatgattaagcttctgcaaagtaactgtaatgcagaccatacatgtagatagtggagaatgattcccaataatacaagatttttactgtcccactttcctagagatgtgttatctgttatgttttcttgtggactccacagtgacctgaaatacttcatttcagtcatgaaagaacaattccgtgcatacgtagtcatcaaagaggggaaaaatgctttgtcccaagaaattcaacaaagaaacatgatgcattgcttgcatagattttatctgtaactgttacagaagtatgatatcctttgttggctttcttggaaaaagtggtacaaccttcctgttgccattgcagctgcatccacaccatacccaactaaaagacacacatgacacatgcctcacatcctctttttatatcctacactcagcagcaggccagcagcctcataaccgctataaatagagaggattgtcctctaccgatgcccaataaccagctcgcggtgtcattgagtgcattcgcttgctctgttcagtcagagcaagtgattcacgtgcgaaacacaagtacctgtccctccaacc

SEQ ID NO: 12273 - DNA, 566 bp, Zea mays
gggctgttggtttttaatgagaccattgcaatcacatgggagctatttattttgtcaaattgacctgagatactttacttgtgttgattggaatccccttgattttaactatatcttaattaagtatgatggtattaaggttcaattcgacataattgttgaaacaaattcgatctctatcagttccttatacgttcaagtaatgaatctttcaattgattaaaataacaaaaattatgtatggttaagatcacaaatggattacaaaacattttctcataacgctataacacacatttatacataagttatcgtgttattaaatgtttccgttgcaacgcacgagcattcacctagtaataataataataataataattaatgctgcttctgaactaccgcagctagcgggtaccaacccggcggcgctggaaaggaaagcctgccgtcctgtcctctgtctccttttgctgccgcctgccggcctggaggaagggagggagggaggtgttcatctgcgcggcggcttcggtgtctggaggggctccgaggggaggcggggagcc

SEQ ID NO: 12274 - DNA, 1294 bp, Zea mays
ctctagaggatccccttggagctcaatttcccccacgtgtcagtaagccgtgaatacacaaatgaatgcaacattagtcttgctttagccaaacactgcacgtatcatcaaactgaacaaacacttacacaagctgaacaacatatttactcaatgttatggtctgaagaacttataagttcaacaactacaggcagaaatacaggtaagaaaaatgatgtccattttgacatgtgttggagtgcttagaatgtaaggccttgcgactgaaaatcatatgttttttcctattaaggcatcaccgtttaacaatttctgattgttttagtatgtaagctgcagctaatgatccatagttgcttagaacaacttttttcatgtgagaatgttagaattgatatatctattattgattaaaatgaactatacatccaactttaaatagttcaaacaggtgatgcttccattacttttagcacaagttaatgatacaatttattacaacaaatatatctactatcattcaaaagacttacaaactagctcaagcgcgtccggtggttttctcgacctacgtgagaaagtcttcttaatataatacctaagggctatcttaacccctgcaggtcgagtttttttactttaaatacaagttaataatacattgctccatcaattcctacaacaactaccatcgaaaacacttagaaactagctcaagcgcgcccaagggcgcgccccattcactagtatgcatgcatggtggcgtgaagcgttgaacaaggttaagaggcagtagtttagttatgcccccatagtgtttattagtacagggaactgaggggccacagagagattatgtgcagtggcagtacgtacaggtacacagctcccagcaggctcagattagattactgatcgaagaagcacagaacgtttccattattgccgagctagacacgtctgactcacctcctccgagcagaacgtctcgcgtgcagcggtgtagcacaccagaaccggtctcgtcgtcgtcaccctcctcatttgacaggatcaacaccttaagaaccaccaaattctcaagctcctcttgtatatcttggactttttaaaatggaagccgaggacgggcggccaaggagttaggtgtaggccaggcaggcagaggcagcagttctcctctacggtacccctccatcgccgtcctgtctctgttcttggctcctggcctgcagctgcaccagctgacaccggcgtcgttggctcggcagaagcggcgttccgatccgag

SEQ ID NO: 12275 - DNA, 1500 bp, Zea mays
tckggctagtgcccacgatcttagacttgttgatttaaacccttttagcctatcattttcctccttatcaatatattaggwagatttcctgcctatttcagaaaaagctggacaaagattttttaatgtcggatccacactctctaactcttcaagtcatagtctgaattgttgtctcctcgtttagagaaactccaataattctctaaatcttaaatttaaaaagtgaatagaaaaacgcttctctaatagttcttgaaatggacttgctaaatttagttatttgctatccaacctcatttactctccagatttggcagctcgataacaactctctaaacgcagttgtcgccgatttcttcacacctacgtgttcattttcccttttcccacacaacgactagccaggcccgacgtgctctttttgtattgtcgcgaggcagccatgttcgacacgcatgaaacaaccttctcctctgtcatcacacaatcggtcacccataggtcacgtcaccgaactatcacttcccagtgggagcaggtctagcaaaactaaattcaacgggagtaggcctatgagaaattgttggaggccaaactattttttactctcaatagctatttagcaacttgctaaacataagtttagagagctttttaatagagaactattagagttactgaaaaggctaaaaccaatgtttcagttaagaaagctttcaatgctaacttctgcttatgtgccttttagaccacacatcctcttgagtacaaggaacacttatctttcaagttcatgtaatagtaaatgatgtttgccatcttttcatgtgtgatgccaatacatgaccgctaaaaccgcatggcttctttaactgaaactgtattttttccctcactgtttgcatagtcaacaacatccaaacctcaccaataatctactataacaatttgtaccacatcaaactgtagcagttctcaacaaacaaaagcagaaaataaagggagaaaaacgcagaccacaacatgtctgcccatgcatcaagtgctgaaagtgagtattgtatgtcgcccgttgcgttctagagtcaggtgaagacttgattcgacttcggcattacagaactttcttaagttaaaaaatgtccttttctttcttatactagtgagcttgctcagaaggtatatgttctgatttaaaacatgagaagagaagcagggcatagcaaaatccaaagttcaggagcgtcaatcttgacttcgtttgccacaaaagaaattcaggggtggcaatgtggactttgtcaaattcgacgctctctgccaacgaagtcaaataggactgcccgtctctataggagctgcatgcctatataaatgtgttgcagccccttctcccatcacacaaacatttcatcgcctcctaaagcagcatcggctactaccaccgactcctgctcacacagctcgtactgtgcagcacatagctagtgaacgacc

SEQ ID NO: 12276 - DNA, 538 bp, Zea mays
ggttgttgatggtgtgagggtcaggtgtcaggctaagtgcaaagtttgcaagtgcgttttgtttgctaaatattctggtggcactggtcatcttaatcggtatagaaatgcatgcaaactgaagcatggcagaaatgcctttgcccagtccctgctctagtttaatcctgatggtagtgctagattgtgggagtacaatgctgatgttgctaggtctgagatgtgtcgtttgatatgtaggcttgatctacctatttgtttggttgaatcatctgcttttgaagagtacattaaaaaggctcataatcctagatatggaggtaaggtggaactccacttaccttatgcttaagcatctactgccttacaggaacacatttgatgtgttcattcaaactcactgccctagagctgtaggtgaacctttgcttttgtctgatgatcactggtatgttgctgaaaaattctggtattccttgaactattttatgaatcaacttgtgttctatctggtgtctactatccaacatcttcatta

SEQ ID NO: 12277 - DNA, 618 bp, Zea mays
tgcatgcctgcagtgtaaacaggagatgtcatgagctatgatatttagagggaccacagaaagtcatacacgtgtaggggcaacaaatgtcaactttcaactaatctaagcgtgaggcagggagcaagcaagaaaattcagatacacatgtaaggtcaataagtttcaacttatctaagtgtgtgaggtaatgagcaacaacagctggaaaaaaagtacagtcggaaagcacaaatgtctaatctatgaccaaactgtgtgaagcagggaatctctgtgactactctaccacatccttgaatattagaatgctcgtcattgagcaatagagctcgttactgtgtcaatcaaatatagacagactactatgcagataatacgagcaaccatgacctaagtaagctacagaatatcaacagaataaccagctccatgtaccaccggatgcacgccctgagcttcttgatgtagacgctcatctgattgattctcccctgcagccgcttcgtgagggtatctccgtcaactgtcgtctgcccggagtgtgatggcggcttcctagagcagtttacgcagccgccgccccgcggcggcggtgggagcggccggcgcgggacg

SEQ ID NO: 12278 - DNA, 1330 bp, Zea mays
ctttggatgtcgtcggaatgcacaggcattgtactatttttactaatgttatggatgtagtaatgaaccatccaaagaattgaagctgaggaagtagtttatctgtgccaagcttttattggttgctatactattgccaagtagtggctttgttgtaaacaatcacaattatgaatctccatgaaatgactctttcgaaattttaaaaggatgaaacagtgtgtcactggttttctagcaggaaccaagggtatagatgctacaagtatcatttgttttgtagcaggacaacaggaaaactgaaggcgcactgcacagtttgggtgagagcgttgcttcatttacaggagtagttcaagtgacaacatctgtggttggtgcggcttgcagcagctaggccagtagcactgctttgaagagatcgattcagctgaaagtgggaaatcctgctaaaagatgaagggatgaaggccatatacatacactccttcaggtgctttgttggatgcgcccaacattttcgtccaagagtaaatacacctgcgaggtctggcacaaagttaaacatctggccatgtactccttcagccatgaaattttctccaaagtttgtgcaagagtttcagggacctatttctttgttccgagggtgtacatatcaaagaagttgtccatagcgttacaatcctctgaaattccttgggcccccttaattttaaaaataagggccaggtgtggaagatccatttgttttgacacaatgtgcttagtagttgtgagctataacactgtgtacgagtcttccgctgagttaatcacttttttgctttacctttttttatagaatggttacttgaaccttgtactagagtcatcgcgtatgatttttttgttgcgccaatatgttagatccaacacgttcctggtatgatgtgttgtctatatcacgtgggtgtttatcttgggtattatctgttggttgtatcttgtcatttttgtgggtgtggggtctggacggtccggtgcaagtgcaaccgcgaggcagactatcgaatgtttgattccgtagcaacacacggtatatatctagtgaattaataataatccaaagaaaaggctgagaggctgtaaagagtgttgaaggacgctcggttccttcaggtgcggcggcgaccttgtctaggattttacccgtggaacgtggcgaccacttccgacgggccactcgccgccgctcgcccgccctgctcttcaccccttctcccgggaccgggacaagcgatctcccgtccccgtagtccgcaggagagagatttttttctcggttgca

SEQ ID NO: 12279 - DNA, 1356 bp, Zea mays
cagggcgttgcgtgcgaagccctcagcgccgacatcgacaagcggactatgagcggcgtgcagacaagcggcgtgatgcccgcaactcttgtgttctgactccgttcggggatttgagggcgctacctacgaagccctcgacgtcggggcgtcaggcaaccaccggcaccgacgcgtgggctgtgcgcgacgtggccaaggtgttcggcggtcggcgactggctacgggagaggagccgtgcgctattgcgcggcctacaggaggcaggagagttggtgcctggcatccaactgtttgcccatccatgatccatccacccctccccgctttgatcttgcatgctggtgcgaatccaatcgtccgaccatcgtagccttgcagcagtagtgctgtcacgatttttctatcagatttgagacaagcaaaaaaactgggtttgacgcttcagcttatatgctaattaagtgaactgttatattaggactaacacagcattacttctccctagcttactgacaactaaaactgtaagactatagttttgttggattatagagaatgcatacacttcacatcgtatgaccgcaagactataattttgctataacatgggagttctccaagataactaagagtctgcagcttcctttcgtgagctaatcgtgtttgtggaacccttctttacaaaagcaataagtctgaaaactgttgtgtacatcaacaaccagtggtgcgccacttcagtttacttgctaatttagtgaacgtctttctgaagcccagcaaggttgagaccacgtacaaatgagaagcaatcatagttgtttagaaaatccaaaagtagattgctgatttggtgtgctttcatttagaacaagaatgctcaaagctgcaagaagctatttgtaactcaaacacgtgttcattagattttaatacccaagtttccttttctttcagttttaatacatctggttaccttttcttttgagcaaacatgtctcacacacacctacagattagagacatgcattcatctaccttttgtgaccgggtccattagaatatgcttccatatatatttacaacaatattttttattattaatccgtccaggcggaaaactcgcgcaacccgcaacgcgcgagtaagctactagtacccatttatgcgttggaggaagatttttatcaacatataccctaggtatcgggtcgtggatacccgttggcatctctatccagaagagacccaattgcccagggccgccgccgcgccgacctcgccgtcgcgcgctttgcttctcttgcccccctgcccgtggcctccgccccaattccagcgggacagcctcg

SEQ ID NO: 12280 - DNA, 710 bp, Zea mays
tattaataccgtgtgcaactacaactacaagcgctacgcaaaatgcagcagctactcccgtgaaaaaggtagcaggaccgatcaaacgaaccgagacgaatttcaggtcaaaaagaccacgtccggatgctagattacaacacctgatgaccaccgatgcgcttagcggagtcatgcatgctggctcctgctgggggaacagtggcacctaaagcagcagcctgccgcgcacggtgtccagtaagcgcgcaacagcagcagcagccagcagcgggggcctcctaaaaaatacccggcgcggcgccctagggcaaaaggaaacagctcgtccagtccgtagtccatagtactccatttgcaaattgcattgccacacctcggctcatccccacctcacctcggcctcacttcacaagttcacatcacgaaacaggagcgtcataaagacatgggcgtcgcagggtagcctcagacggtcagaccagtgacgcagcggcagcggcagcgggcatggggtcctgagtgaccgactgcgaaggagatggctggagcgcgacggccccggagccattaatggggtgctcatcctcctccccctcctcgcctcctccccgccgggtcgcggacgcggtcggctccgccttttaaccggcctgtccgggagcggggcgccggaaccctagtgctgctggtggcacgcggcgcgcccc

SEQ ID NO: 12281 - DNA, 981 bp, Zea mays
tcagttataatgagcaattttttaccttaaatgtacccgttatgtgatgtatgctctcatgaggcactcgcgacccctcaagtttgctctagcttcgcaactggctgaagggtagctattttatctttgtctgaccacaacctaagtatatgtggagaaggcaccggagatagggcaacagtctggcgtggggtggactgccactctaccagtgatggggtggaagtatggccagttggctatgttgaactaaggttggcagctcaactgcaaccgatgttttacaggcgggattagagaaaaagaaggaaggttgggtataatatataactaaaaaattatgtatgtgtccataaaatttcaaagaccatattaaagtagatcattagaagaggtaatctatattctctatgaatgaagataataaaattatagataaatttctccctttatgctagtttggaaagttaaatctcatccgtaatttctgggaatgtggggaaaattttcccctcaaattcaaaaaaaatcccagaggtgatttaagtttttaaagttgtagctaaatagaacggatagatcagtaaatagagagagagggggaaaacccgaaacaatgtcaggcccactgcctggggcgagggcagggtccccttgctttaggtgcaagcttggttggcactgcagtgttttattgcgacacataaatctataacacctaacgctttgtatgggaataaaaaggcaaacggcgagcctgcatcaggcattcagaagcagtgaagtgagagaggtaaaacaagctgagactctaacttcaaaggaagatacacacacaaaggacagtgagaaggaggccaagaagcttgctcgcaaggcgctagggaggaagaagacaaccacgcactattgctgttgcttgtgcttagtgtgtgctcgcggctagaagcagacaagcagctgcgggagcataagggcggc

SEQ ID NO: 12282 - DNA, 301 bp, Zea mays
cgtgaatttgctaaatggttggtctgagcttctttattgaaacacaaggaaccaggaggactatttggtttccgtctttcagcatgttgtttcaggacagatgaggttccaagctctcgggaccttcacattgtggagcctccaattgttcatgtaatatctccatcggggaatctgactctggtttatcctattgctatgtcagtggtcttagttcattgttcttgggttggctccaacctccccagatgatagtgatgcccgtcacccatgacatcggcagcgtcaggagtcctcgtcg

SEQ ID NO: 12283 - DNA, 337 bp, Zea mays
cacgacccaatctccacccacatactgggcgccgagaaataaaagcatcaaccaaaggcaacgtcgtggctgagaccaacttcagcacagcagagactggagggagcgacgttttataaccacgaataaattttaatattagcaatccaccgtgttcagctgatgatgaataattacatctctagttggcctgatatgggattgtagccggacgcgccttcatatagcggccgtcaggaaccccagcaagcaacccagccgcccattgccggcattgctcgcagcgctagcttcttgcgctcatcagtcgtctccgaccaagatcagcaaggacggc

SEQ ID NO: 12284 - DNA, 1500 bp, Zea mays
ttctggatttatttatttatttatttattacttggtagcgtggttagaaatcagatttctagcaggtcaaactgcagcaagaatcgcgcgcgggagcaggagcctgctagatgttcgtgcctcggcacgagaccacgcgttctcgatgcccagcgttgctggagcaaggtcagcgttggtggcatgacgtggcaccgccgttcgcccggacacgatgccattgccagcgcccagcaccaaacagaacactccctccaggcctccagcttaaaagcgccccaccaccgctcaaggcgcttactcaactcaaatccggtagattcttggtgttgcattgcaacattctaaaccacgctgccagctccaccgtgccggccgccacctcgttcgtgtgtctcaaagccccgcgtccaccatggcttcggcacggcacacgctgctcctcgcggccgcgatgtcggcgctcgccgtctccagcggagacacggcgtcggagctgatgatctcgatcatccacgcgcgcgtggcggcggagtgggcgtggccgggggccggggccgcggcttcttccgacgactcgtgctggggctcgcctcgccggaggagtgccccgtctattacggcgtggacgccgaaggcggcgccgcgccgtgtggccggatgcgcctgctactgtactacgacgtggacaccgcggccagcctgctgcccacggcgcagtacatcagctacagcgcgctgatgccggactcggtgccgtgctccgtgccgggggcgtcctactacaactgccagccgggcgccaaagccaacccctatacgcgcggctgctcggccatcaaccagtgccgcgagtagctagctgactttgctctcttcttcttcttcttcttcttcttcccctcagatctcgtaaaatgcaattccacagtaggtagagctaaaactacagcttactcgcaaaccgccacgaaacatggtaaagtctacggcttacttatgctaattcgcaaaccaacaaggggagatgcacaggcatacgcgcaagcacgaagaggtacaggagtaacaagcataggcaaagatcggcgatggcccgagaaggagagagcacacggaccttgatctctcgaaggtgagcacggaagaccgaagacaactgcggcggcggcggcggcggctcgatggttcgagtacgggacacctgctgccatttatatgagaagcgcgggtcgtaaaccctagcattcggttctgggtccactcacagcgtcacgttccattcctcgcgtgttgggccgtatcgctgtgcgcctttcttcagaccaattagtccatcagtaatgggccaagcccaacacgataaaacggcccgcacagtctaccggttctcgttccgtttccctcctctctccgaagtcccaaccgaacctaaaccaaaagcaggcgagagtctagaccgcagcggaaggggagcaggcggcggccccgattgcggta

SEQ ID NO: 12285 - DNA, 1421 bp, Zea mays
cctagtgatggatgaaactatttggagtttaattttgatagtgacacaaaatcttctattccacgacgttatgcaactctgccatctgttctacaagattgctattaaggttgtagagaatgataacatttacacaaaatactccaacgaaaattacgacacatttagttctgttttatgttacaattacctcaaaatacttcttgatgcattttacgtcaatttacgaaattcttgatgcgttttacgtcaatttacgaaattcttgatgcgttttacgccaatttacgatatttttatgtgttttacgacaaccttgtgcgaagcgagatacacaacaactattctaaattgtgtgtgacttttacactatatatatatatacatgagaagtttattcaatttttatgtctgcatgtgtgctacatactaatctgcagtgaataagctcaatatcaataaatgttgcccaagtagtcttcttccaacgagtatatttattgaatgtaacgagtgatatagtatagttatatagatgacaagtcttttacgatgaataatgcacttatttatatatctaatattttattttatatgcagagataaaatcattatgattattttgcatacaaacaatatatcaagacatttggagtattacaaataatttatattaaatctatagtttcacagcaggtttaaccaaacaactttaacttttccacaaggaactaatttgcacatacaacattacattaataaattaattatatatagcctcatcaattcaacacatcttcggttttatggttttaaatatgtgcgtgtatggatcgattcaactactcagaattatatgtgcacatatgaattgatcaatatagagatagaaggacttagaaaaattattattaattgtttgttattctgaaaacttctttaatagtaaaattaatacataaagtaaataaaaattatatggcgcaatccacatactatcagatgtgttatgtatgtgagatgagatgggtgtgggatagaacatttgttgtgttacatcatattaaaatgggatacttaacttatatagacacataaaccatgaataagtgccacctgtacataatctagaaaaatcttaacaaatatataagtctaaagaattcctaatatatcttggcaacaaatatctaagctctatatcttatcatttttactgaaaattaaaaaacttgaaaacgaagttgtgctaaattaacgatgttatatataattaacttattaatgtaatgatatatgtaagtcgttcaaattaattcttcgtgatagtatgtgatactataggtgtgattagctcaacgactttttcacatttttcacatctgaatcaacgcaccctgtgcccggtgccgccgacccaa

SEQ ID NO: 12286 - DNA, 576 bp, Zea mays
atgggaaaaatagaaatcccttagaaaattgaggtttccaaactagccctaaaaggaagatctgccaagacgctaatactactcatatagatgtagccatgcaggagtatataaagttttgtatactccaaacagcttgatatctgtaatttggttcccatcctaagaaagtccagactactactagcactgcacctttgctgcctgaatgatgcacaatgacagccgtaagcagtagcagagatagatcaatgtgtacttgtcgcgttcaaagttgctgtaccatcagcccaccagcaacgacgacaagtcgggatgcaaaactgatggcttgcgagctacagcccgaaccgcatcaggcccggcccaatcacaacatgctatgccgtcatcgatccgttcggctgattgagcctggcccaaaacaaccagaagcgcaaccttggaattggaagcgtagcgaagcgagagagactcgtggcgtggagtggagtggagctggccgccgaagagagaccccgagaggccgagagaaagagagagaggccgtgctaggtgtggtgagtggtgacccag

SEQ ID NO: 12287 - DNA, 864 bp, Zea mays
ccaacttctctgtagtaaaaatgtagcatatttgacatttataaatagtagtatataaatatattttacataaaaccgtatcagtttaattgatatgtgtataaattattattattagaatgtaatttaattccaagtatccaaacggcatattaatgatgttactatatgtgaaagtgaacttgtcgctttagcagcctgtttaattcatgatggcttatgttttctctctggaaaatagaggaaaaacatagaaaaatcgtttggtttggggtccgacacgacacgaagtttagtcaacttcgcgtctctttctcgtgcttctctattcgccgttttaatgtcccgtccccctatcggccaccacttccccctcccctccaacggcgagagatcgaatattaagcaccgccgccggcctcgttctcctctcgtcctctgggctagattagccggttaatcaatcaatcgattcgttgttgctaagagcctttttaagtatgggattacgcaggtttcttgtttcctaaccaccacttctgtactagtactatactataccaatccatggatagagacagacagaggggttgggttttggttgcgctgcttgactcgccccgtgcccgtgttcttgctgcccttttcaggcatatataacattcctctttttacactacatccatccccgcttgattagcggcagccactctctccctctccactcttggtgtccgagtcccttggccgtacgctctgcctcactcctccgtttcttgcttctcctgccgccggcgtcggagagcgagcttctcggcgggcggcggcggcgcgcggcgccgggtgcggatcggccgcgggtgc

SEQ ID NO: 12288 - DNA, 149 bp, Zea mays
ggtgctggcgctaccggcgttgacgcagctcaacctcgcgcagaaccgcttgtcggggaggatatcgccggccattgccaagaacgggcggctgcagctgctcttcctgaacggcaacccgccttaccggagagctaccgaacgtcagc

SEQ ID NO: 12289 - DNA, 135 bp, Zea mays
ggaggccggaggcgggcgaggaacgtgaataaaatatcattcggagaaacaagagaggccggggaatcgcgtcggaattccggcgaatcggcgggatccggccgggatctgcgcgccggatgaggggtcggcacc

SEQ ID NO: 12290 - DNA, 217 bp, Zea mays
cgatcatcgaccgcgctcatgcccacgccggtttcttcgggataagatcgagtgtcttactttatctatcctggcggccacgatgtagtcgttgacggtgaggctgtcgccgtcggcggagggcgtgtagagctcggccgtcacctggttgggggcctcgaacgccagggccgccggggcgtggccggcgccgtcgagcgcggcgttgatcctggcg

SEQ ID NO: 12291 - DNA, 167 bp, Zea mays
ggtcccaaaaaaaagctctcgatgcctccctataaataccgctattatggcagctcacctaagagctaagagggaagaacaatcgagctactaataaggtcgtatacatatcttctatatactcctctgaaagttgtgaactccggtcgagcttaaaaacagcagca

SEQ ID NO: 12292 - DNA, 1393 bp, Zea mays
attctgttcatgaactgaccatccgtgccgccgccaccgtagaccgtcctatgcccattttggtgctcaataggaacgcatggtatatgcttaggagttagtagtgagtatattttggtgctcaataggaacgcattgtatatgcttaggagttaatagtgagtatattttactagtattttttttaaaaaaatctatatacacatgcatatacatttattccactacaactcgtggtttggaccggtggtggtctcaaaaaaaatagttactgtactcgaatgtacatgcatgttcacgtatatataaattaactagccagtttcctgcactttattacggtttttatatataatataaataggtattgagagatttatttaaatacaattattgtttatttctaaacactaaggtatgtgtggtttggtggttatttctaaatttctgtagtagggagcgtgcgtttgagttctttctcagcactattttttgcgcggtgtggtagctacgcgggcggagttgtgtgctgggcaggcgcagtagctgtgagggcgttgcgcgggcgctagacgtggggcccacaaggcacggtgtcgaggcgcgtggggcgggagaaccarcgaaagcgagtaggatggacccaaagtgtcaacacagagggtaaagctttgatagtattcatgttatcaccattgacttcacgtcgagacatgctaaaagaaaattttaatgtgaccatatgttatgtagtttttttacttgagatgaataattttatacatgtttgagtatttattagcaacatattttatatatactatgagaataagggtctttatcttaaggatatgtttggttagggtgtgggtgtggaaaaaaaaagctattgtagactgcgagatgtagaaaaagctgctatagcctataagttgttaaaaactgttaaaagttatttcatatatattttcacagtttcattcaaaatccactaaaatcgggtccatatatgctttyagttttggtctcagtccccgatttgccaggtccaccactggtcacagtcggatgatgtatgcggcacgcagcagcacacatgggtggattgacatgtgacttatctctgaaaacggaaccatagcagtagtccaaggaattgacatgtgacgcatctcagaactttcggatctgctttcagaagcctcctggaagaaggtttgccggtcgcaggccggatgtataaattgcagagcccggcaagccagaaatattattcaggcaggcgcattgactgatacacatatatacaacaagcaaggcggctagctacagcggctagtgcgcgcgtggtgcaggcgcatctagctactacctggtgcttgttgtgcataca

SEQ ID NO: 12293 - DNA, 1500 bp, Zea mays
atcaaatcaatccccaaccccacgaacgcgaatacaataagcgcggcacgcaccgtgcggtgatcgatgcggccgacgcaaacgtacaccaccagcgtagctagcgccaacaccccggggccgatcgagctgcggctgcccccaccggcgccggaaggccgtccgtccgtccgtccggctgacccaaccaccgggcagatcgagagagcacccatgcattgcagtctttgcagaccggccggtgaaaactgcgtcacgtccacctgtcatccggactggcggcggcctagctatagctagcaatcgagcgccgatcattgcggcacctaacacgggccccccatagcgattcgggtgcacgagcgaggcaacgtcaacagtccattgctagtcacccctccaaatcctccgcggctagtagcagcatgtagtggtaccactcacgtaggccgcgcaccggttatggaaagggactcgcgtggccgtacgtgggggcagcggggttttgaatgatcgcgtgatcgtacgccgcagtggccagtgggggccggaacatacgatacgaactgggatggggacttgggagtaagagtaaaccaaaacggagttggtgggtgtgtgtctcggcttcttccgttcttggcgagtctctaaactgagttcagaccgacctagtacgtggaggacaggcgaatctagcccttgagttcttgaccaacagccaaaacctaccagttactccgtattacgtaccagtaatctactccctccttttccagtaatctactctcttaaaacaccttacaattcagaacctaggtagaaccgaagaagaagaagaaggatgcaagtccaaaacaaaccatcgctgttacactcagaccaagcaagcgtcgatgtttctttcttattcttcaaaaaaaaggcgtattggtacttcgcccaactatcccacgatatcatgcatgctgctagagggtccacagaaactcccatgcgcgctctcggaaacggagtggatatatgggaacagacgagcagtagcactacacagacagcacacaccaaaaggtctggggctcgcaaaagggcaacgtgcagtcgtatgtccacacgcgcgacgaaatctggaccaagatagttttttttttctcaaattttttaacaggtgtagcagcagtaccagtacgtgagcgtgcggccacgaccaaacctgtcgcgaaatcaaggaagggccccacctgccagctgctcgcacgactcgtcaaaaccggtacaagtccaccgagagaggcccagtactgggagtgggagggggaggcacaggcaccataacgcgcgcttcagttccggaggcctcaccgcctcacgcaggcacgcacatcacacaacgccagcgagaaagagctctcgtccgcaccacggcgcaaccaacggggagaagaggaaggcagtgagctgtcccgcgcgtgcgcgccccgcctcccgcccgcccgtctg

SEQ ID NO: 12294 - DNA, 90 bp, Zea mays
tgcatgcctgcagatctcaagcagttcgttggttggccattttcttttttctttttttgatatacttgctagcttggaagttggtaaaag

SEQ ID NO: 12295 - DNA, 1500 bp, Zea mays
aacagtttttaactattcaaaaaatttcgttacaaagttatgtaaactgtgaccattgtcgaggatggtgacatcttctctatctaaatttgtatcagagtccaagccttattcaaatactacctccgttcataacaggcccgtctactgccccgtgcatatgagacgacggcacacggcctccaactttttggggcccaattttttgagttttctgaatataattaatttaagaaggtaaatattgtttgatattttgtaaaatgatcggcaaattcttaacctcaaaatagataatacgagaggataaaaatatgacaatatatcaaatattaagagcctattttagactacttatatcactatgtactataggtcatagcgtctatttttatgttttacaccaggacaaaaaaaaactcagagacggccctgattcataaatatatgtcacgttgatttttttaaagctttgaccactcgtcgtcttatttaaatatttatgttaaaatgtaaaattttgagtcaagcacaaactagattaaatgataaaataaatcacaaaaaatgataactcgttattttttaaataaaacaagtgtttaaagtttttttaaaaaaacagcggtgttatatatttatgaatggagggaggaaaattcggactaataaggttccacaaaagagaacatggccacagatggtcttcacgcccacattctagaaacattctgtgaacaagttcgaatrtgaaattgaaatccgacgaagctatacaacatttttttttgcaaggaaactatgtacaacatgtgaataaacacgtgtatggaatgtacggcaaagcaatgtttcttgaacttaaaatttaatattttttatatttacagaaagaaatgctagtctcgactcggaccgaaattcgcacatctggttcgtatttacatccaagcagatctgaaaatttgtgcgtgtgtgggtggcttattgaagggtcggctgcgctgatcccggcatcccgccccctgatccccacgaagggacggactgtcctgtcgacgaaacccgaccatcaacaccgtaaaataagggacacagggtccacgtgatcggctctcggcagtcaccacgagccttttgccttttcgctcaaggagccagccgtgtgccgacccacactggtccacagttcctttcgcttttgcgcgggcagtgacacagttgggttgggccgttggggtcggagccagccagccagctgccgagcccaacgggaggagggccagaggacgctcgctggcgctgccctttataaatccgccgtgcgcgtgccccgcccccgcagtagtagtacacagcatcatcaatcgacgcaagcgcaaccacctcctcccctcgtgatccagccctgccccgcttcgtctagttgacatcatttcccttgcgccttcttgccagcaatccatccaatccatccatcgtgatcacctggcaaccaaa

SEQ ID NO: 12296 - DNA, 957 bp, Zea mays
ggtatttttaccgaggtatccggaaccgtgcaaggtcccgactaatcctcgttggtgcccctacgcgaagggaagcccacgcgagggccaagcacctcggtcgagtaactccgtagagagccgcgggccttctccacacgcaagtggtgctccgcttccggctcctctcggacgctccccgccgtctccactatcgagcttccggccgaaacgccgcgggcctcgttccctccggtacacggtggcggccgtgacacaaacgcggttgtcacggtctcgcaagactctcgccccactcggtacaattacaatggctcacgcaagagccgaggggttgtgaggtttatctaaactcactcaacaatctagggttcacctagagcaagcgctaaagcggtctaactaacctaagcacttcgcaaagcacctacgctaatcaccgagtgattctattaagcacttgggtgtttgagcacttggaaatgtctacaatatgccttggtatgttgcttgggctcccacacttgagaatggccggttggggtggtatttatagcctccacacccccaactagccgttggacagaaagcagcagctttctgtcgtcgggtgcaccggacagtccggtgcaccaccggacactgcacagtagatgtccggtgcacgccacgtcagccgaccgttggcgcctatagcagtcgaccgttggatccgaccgttgccgtctgcccgttggcacaccggacagtccggtgcacaccggacagtccggtgctacagccagagagcgcctgcctgcggcctctctgcgcagactgtccggtgtctcaccggacagtccggtgcacaccggacatcaatgtctggtgcgccaccaggcgctggctgacagcccacttcttggatttcttcgctgatttcttcaggcttcttttgttcttgagtattggactcct

SEQ ID NO: 12297 - DNA, 356 bp, Zea mays
tccacacgagagtttgcttctctactttgctctttaagtttccgcatttatattaagcatttaagtttcaatcttgtattcatacatatctagtgtagattgaaacttagcctttgcggtagagatagcaacacttagacaaaacctagtttgcacattctagtttgactatttgcataggttttgctctagggatttaattgtggcctagtttagcgaaagttttagaagtcctaattcaccccccccctcttaggcgtcacccgtttcctacaagtggtatcagagcccggtttggctcatttgaaacgctttagcttcaccgctaaaagagccgacgctttttggaggaaggg

SEQ ID NO: 12298 - DNA, 1500 bp, Zea mays
agattgtaaggaaaatggaccccgggccatttggctaattgagttttggtgtttgatgaacaacacaatccgtgaactaataagttttctagtgtttgtgtttgtagttcacaggatgcgaagagaattggaccaaggcaatgaggatgcaacacctcaaaagaagacataaaaagatgcataggagtccaatactcaagaacaaagaagcccgaagaaatcagcgaagaaatccaagacaagggctgtcagccagcgcctggtggcgcaccggacattggtgtccggtgtgcaccggactgtccggtgaggcaccggacagtctgcgcagagaggccgcagacaggcgctctctggctgtagcaccggactgtccggtgtgcaccggactgtccggtgtgccaacgggcagaaaggcaacggtcggatccaacggtcgactgctacaggcgccaacggtcggctgacgtggcgtgcaccggacatctactgttcagtgtccggtggtgcaccggactgtccggtgcacccgacgacagaaagctgctgctttctgtccaacggctagttgagggtgtggaggctataaataccaccccaaccggccattctctagtgtgagagcccaagcaacattccaatacacatagtgcatatttccaagtgctcaaacacccaagtgcttaatagaatcactcggtgattagcgtaggtgctttgcgaagtgcttaggttagttagaccgctttagcgcttgctctaggtgaatcctagttagttgagtgagtttagataaacctcacaacccctcggctcttgcgcgagccgttgtaattgtaccgagtggggcgagagtcttgcgagaccgtgacaaccgcgtttgtgtcacggccgccaccgtgtaccggagggaacgaggcccgcggcgtttcggccggaagctcgatagtggagacggcggggagcgtccgagaggagccggaagcggagcaccacttgcgcgtggagaaggcccgcggctctctacggagttactcgaccgtggtgcttggccctcgcgtgggcttccctttgcgtaggggcaccaacgaggattagtcgggaccttgcgcggttccggatacctcggtaaaaataccggcgtcatccacgagagtttgcttctctacttagctctttacattccgcatttatattaagcatttaagtttcaatcttgtagtcatacttatttagtgtagattgaaacttagcctttgcggtagagatagcaacacttagacaaaacctagtttgcacattctagttttgattcttgcataggttttgctctagggatttaattgtggcctagtttagcgaaagttttagaagtcctaattcacccccccccctcttaggcgtcacccgtttcctacaattggtatcagagcccggtttggctcatttgaaacattttagcttcaccgctataagagccgacgctttttagaggaaggg

SEQ ID NO: 12299 - DNA, 1106 bp, Zea mays
gctgaagaaaaacacgtgaccttgaattgtcgggcatcattttcagaggaccaattcatgtcactgaaatcttactgctaaggatgcaaccaagtagcagaagagaattctcttgccctttgttagtcttggaaactggagcttgtggagtgatgcttcctggaagcgccattgagaagtcaagttgacaacaagtgactgctaacaagtagagctatctgccttttttgggtaatgtttcaggcagtttttctcaattttgtggcaatcactgatgatctaaataaaaataatactactacactgctgtacgtgaaaactgaacagatttgctgtctggaaatgtaactatttttaacagttaaggggtgtttgaatgcactaagctaataggtattaagctaataggtagttgtctaaaaaattgctagggtaattagctagctaacaaatagctactaattattatataatttgctaaaagtagctgatagccgaattattagctagtctattaaatgtctttagctaattttaaccgctaattattagtttattacatttaaacaccatctaaatgcatgtgcagctctttagctggtcaaagaccgttacttaaatccacgaactttgaaatgcacttgcgtgccacttacatgtcggcgtaccggtgcgtaccgtcgccagatgatgagctagcgcctgcgattccgttatattattataggttgttgatcggtggtcgcgtggtctctttggaaggaacggattaacggaataggaaaagcaatcccacgccaaaaccgcgtcggtgcttctagttgtagtgctctactgctcttattacactacaacacgtacgcaggcacccggccagtccacgcgtcctcagctcggctgcctagacgacggacggacacgtagctgcgacgtgtcgaaaactgccagatccaacacgttgcacgcatgtatcgtctataaataaacggatccggcctcgtccatttcatccatcgcatctcgtgcagtgacacaagtgagctcagtaaagccagccaaagttcagacttcagaagaagcgagcgagcaggaggaggacaggaagt

SEQ ID NO: 12300 - DNA, 1500 bp, Zea mays
attcaaaaatcttcttggccttttactcacttggtgccaaagtaaaataagagtttaggataaaagttttgactttaaaatcctatatagaatatatcaatgaacaatcattagttcgtgagattgcaaaaatacacacatataacatataatataagaactagtacactatacactacggctatagtcatctatcgaatacgcactcagggtgtcgccacgtcgtgttaggagtctgtgacgatttattttctctgtgacagtaataggcttgtcggttcgtttcttaggtttccaacaagctacatctagcgaacagactatcaaatagtgtttgatccaagactaattactaaatatttatagcacacatcatatacttaatacatatttaggggccccataacttcgggggcccagggcggccgcccaccctgcccacccccagggccggccctgttggtggtaaggacctttttttttcgaggcacatgatgtcggtctagtcatcagattgactataattagagcgtgtggtttatgatattttgttgttttaagctgtgtgatgtttaagcgaaagacgttttaagagattgtatcacatacttgaaactacaaataaaatcttcctttgtcagaaaaaataaacacgcggtgcccccgcgaggaacagtggccatcaacaaatgctacggactcaggaattaatttgtgcaagaaatggtgcagagatggatttatttcttcacaggaagaatatagagagacagaaaaaaaacgtgcaatgatccttgctttccaaagggctaccgcggaaagggacgcgtagctgtgtgaagtcaagtgtgccaaggctcccgctgcgacgttcttctatttaataaaccagctaaaagggaagcgaagcacgcaattagaccgcctaataactgtggtctgtggagtaagcaccgcgatacacagtagtcccactcccaccactaccacggcggaatggggttcggctgtccgcagagcagaacagagcgttgaagtgaagaaaaagaggcgcgcagcacagggcgaaaaagagagagacgatgccgtattgacattgcaacaagcaacgagaagggcggctttgtcaggcgcggaggccagagagcagcagacagagagaaagagagagagagagagagagttgggtgcagtgcagcagtgcagagagcagagacggagcggagcgaccgagagagagagagaggggaagtttaataatatatcccatcactcacacgccacggcatcattcgccgcctccttcctcctcccgctcgtcgccgttcctcctccgagcaccagcagcgcgccccctccgctctcccttagctcaccagccgcctcttcgtcggagcagcaacagcagctgtgcatgggagtgggagcacggctctgagaggaaaaagggaagaagaaaggtgaccaaagggaaacaaagggaaccaaaggactaggagg

SEQ ID NO: 12301 - DNA, 1079 bp, Zea mays
tgcatgcctgcagcatgtggtagccacggtggggcccataatttgcatcccagcactgcaaccagtaggtgctgttggcgaaccaatctcacctcccagccccaagagggcacttaattctagttctacttgtagcagcagcacgggtaccttcctcctcgtgatgattaattaaaacgcacgagcaaggatgacgatgcactatagaggcatagagccacagtgtaccgcagctcgcgacgagccagccagccaacgaccgctctcaccttcttcgtcctcgcagccggagatggagcagtgtagcacgtaggagtagttcgggaacgaggaattcgctttgccgtcggcgacgggagacgacggacggacgctgcttcctctggcctgggcgtctggcggcctgcacacctgacacctcgcctcccacagccctttcggccgccttttggctttgcaggctttttgcgcctcctgctgcttccccgtccctccccctccgcctcccaccggcacccccactctccacttctccagtcggccgggcactcctcccttgccccggcctcacaccaccacacgtccacaatgctgccgtcctccagatcgaggtgaattactttcgccctccctgctcccggacccttgcgttctctctctctctctctctctctattatatatatatatatatatatatcttatttttatttgctcgcgatcttgttccgcctgtcggttttatcttcttttcttcaatggcagatctagtagtatccagtaatccagctagacccgacgattcatttggtgtttttttcttggatatcttcttcgccgatttccatgcgccgtagttgcttttcatcgtcaaatgtggtgtaccgtctcgtatggtgatttcccgccacacgcgaatgtgcctttcttcagatggtgtttcatctctgtaaatcctcaaattcggaccgtaacggccactccgtctctcacagctgcatgccacacgcgtcggttcatgagcttgcgctcgattcggcaacagagaataatagattttcgatttttaattaattaacg

SEQ ID NO: 12302 - DNA, 270 bp, Zea mays
ctgcagcccatagaaaagttgatctcatgaattcgggaagaacagcggcatccaacgtttcctgttcagcgggaaacagcggcagcttccctccctgcctccttccaggatttcttgggttcccagttgttttcgtcaatttccacttgttcaaggccattgttcgcagccctgcatcttccgttgtcttgggaatctgtgaaggagccttccttaaattgtggcccaagacttcctagtcttcttgcggaatctcataggttctcgaag

SEQ ID NO: 12303 - DNA, 740 bp, Zea mays
ggttcgatctccgaccaagttttgagctcgtgcccagtctcgatcgggaaaaaaaggcatccgcgttccgctcggcgcactcgcggagacggcggcaacgccgtggccggacgcagcgactttatgatgggttatccgttcccctagccggtgcatgggctgatgggcggcacgcgtggccgggccgacggcagctgggaatgggattagttggacgtctgctgaccgctgtcctgcccctggccccctccctccgttcaatttccccaccggacgcgccttcacgtgcgccggggacgcggggrtcggttgatcgcgaaaccagatcacaaccggggaggatgccaaggacaaggagcccacactacccaaatggactgctgcgcggaacgcggagggcccgacggccctgatgggcgccacgcgggccggctcgccaggggggctgtacgcggcccagcctgtgagcacgcaaggtgaagtgacgccgggacataccgagaagcggctcgtgttgctcatcccatatgcacaagctcgtgttccatgaggcgataaagttctctactgctctcgcgttcacgcgcgaagccgaaaaccctttcgcgccccgcccccgccccctccatctccacccgtctccctcttaccgccgtacacatccagcattcctccccccaaattctatgccatccacgaagtaaccgccgatttccctccccgcgagccacaagcccaca

SEQ ID NO: 12304 - DNA, 335 bp, Zea mays
cctccgagccatttaccaacccatactcagaatatcttaacaccataaggtccaaagctcaaaagttaccaacaaaaggaggcacccattttaatcattaatggcctccccctccgacaccccagactcaaatcaaatctgccttgtctctgctgccccagccccaactctgctccaaagcttcaagcatcagcaaccccctccaccacctcttcctcctcggtcctcacctggagttgtagcaagcagcaccacatcatatcacagcagagcagagagtggggtgaagcagggagctgggcaggagagccccaacggcctgtcctgccgcggcc

SEQ ID NO: 12305 - DNA, 102 bp, Zea mays
agtgagtgcgtgtcattccgggattactgcggacagggaaatgttgaagggtctgtctctctggctgcttagctctttcagatttttgcctcatcagtcatc

SEQ ID NO: 12306 - DNA, 729 bp, Zea mays
ctcacacatgatatatagaaaccactgtaaccatgtaccggcaatttggataaatttttggactcatctacagcttttcatatggatgtggggtttaaatggtaaaaataagaaaaattatgcacaattgttggctctaaacctacgttcatatccacatagccactagaacacatgtttttatgttttatactctatattcaaatatactatagagattttatagaaaaacaatgaaataataaaataggccaagtcatgccgtgttcgggttgaccaaaactttgtcgggccataggccagcctggtttatttggacatgtatactcgtacaccatcgttgcgcccgtatagtaagtaacattaattctatttcagtaaggtctaccttaaatgaatagatatcgtcgcacgcacggacacttagccagtatcatctaaagtttgagaacttcattttcgcaagtaaattttatttctcttgggaaaatgatttttttaaaataaggttgtcaaactcgtcctaatatgttgcgtttccgtttttcctttcttgtatttggaagtgaagtggaatgaggcagcacagcctgctcctatagccgatgagatgaggtgattgaggtccgtccaggacaaaaaagcgaaacgactccttcagttccgtcccgttcgtgacgacctccggtcccgggagggggagggggagggggagggagaggcgaggtc

SEQ ID NO: 12307 - DNA, 1500 bp, Zea mays
ttgtagtttgctcaattcatattgtacagtaaatattaattgatccacacgacatgtgttcatcaaaataacatataacatacatatacaaccacaaactccagttttcatgcaataaacaatcagcgaacttcgcaatactcaaatacaagttcttttacaactctccaacgaggcaacgacacgtaggttgacttatttcacaatactcacatatttatctcgagtcatagtgatagtactcaggcatgttggaaggatcgtgatattgttctaatccgttatagcgatagtgataggtctatacaaaatatatgagatacattatcgagaaaacaagattggcaaataaatatttatccataaagcaaaaaaaacataccggtatgtgtgttcggcgtttgtgtattgcatgtgcacttcaccaagtgttggacttttctcctgatcagcaaatcttaggaacacatatagaagaactggagctaagagttctagattgagtcttgtctagatggatagttattagaagaactgaagctacttgatctacggattccatcttgatcaggaaatgaaaccgaaattgatcactaaatgtctaaactggacttgagctattggtttatcttcacatataacatataacatcttcacatatagcatataacagtaaacaagactaatataactaaattgaccactaaatactcagttttggtattaaatctgatttttcggcaaaaattagcggtttatcggtctcaaataacggtttaccggtcccagaaaacggtttaccagcgatttttgatttttatgaatttttttaaatttttgaattttgaacgaattttgaaaaaacccggtggtttaccgaaaccgcaccccggcggtttcggtaaaccgaccggtttaccgccggtttttaccggttttgtaaaccatgactgagtggcgacgtggccggcctggcggggccatgtggcacgtgaagggcgaggtgcatgtccacctggcggcttccgcgcggcggggcccgcccgcatagacgggtcggccggggggaaagatatttgcccacggcggccggcccacgtcgctttccaatctccgctcctccaatcggctccccgcgcccacgtgaacgccctccccaccaccccgcttttttcctcccgcgcccgctccgtgcgctcggtgcagaggctcaagccccggcgaggcggcgcccactctcactggccgtcgccgcggccagtgagcgggtggaggagccgtggacctctcccatcgaggcgccgggcggcaggcggtgtcctcatccgtggcgcaagtatatgtaggatcgtccccggtcgactctgcagtctgcacggcgccttatcatcacacacggaaccagattgcgggcagccatagacgaagagagaaagaaaggtcaacagggcactgcttgcctgctgcgtagtgactagtgtgcctcaaccaaaaggatcc

SEQ ID NO: 12308 - DNA, 441 bp, Zea mays
ttttattttaagaattcccacatcacacatttttattttgttttccctgttcctttttctcttcctttccattcaattaatgggatgtttgataccttacgattgcaccaacctgttcaattgtacttcagatagcatcttctttgattgtcttcttctgcatactcttgtgaatggtgctatcatattcttgaaaaccttccgtgctgtcaatcgggcattcttctgtctctgtacttgtccttaaacagtcacttgcttcgaggttccattttccatgtggatacccatggctgaatccactttgagattattacataccttttgttctagctgtttctgttgtttttctttctatccatacattatcacttggctcccccaatattattggttcatgtgctctttccaaagtttccttggaactttgagctttggaag

SEQ ID NO: 12309 - DNA, 1500 bp, Zea mays
gtcatcaaaattattaagaaaactacaaattcaaagaagtagatatatgcttattaccaaccttaaaacatgaaagctactatttccatccttaaaaatccaaaaaccctacacgcgttttttttattttttttgtaaaaaaccgcaacaatgaaaagagaggtggataaagcaagaggcgttttctagaataaatgcgttgggggcggaggtgagataccgtaaagccattattactacctgttcaaaccaaaagccggcagcgatagcctatataactttgttggctcctgtcttattacaatgttagtatcgctgctattttgtaacttgagccgataatgacatgtatcatcattctatgattaaggcctcttctgttacttttagatgatgtttggttcggtgaaatgtaacgtgatccggttatattaccgcggcaactgattgcatcgtatcatgtttgtttgagccacaatgtaatctattaccctataatcgaatacggacttatagatagtgtgatggaataccagcacttatctgagctgaaccaaacaatctaagtgatgtcttacttctttttcatttacagtgttattaccagataacattacccgataacatttacgttaccgttcaaaatccacaaccaaacagcactttaagttaaccggtgatagatgaagtcctcagctcagcaggatgcacgtgctgccgttgcccattgcaccggcggtcgtctgtcgcacagctacccattcatgctctgctcggctcttggtcgccacctccgcttgtttttctcccttgtctgcatctgaaaatggatacgtagtagaccagagagcggctgggtaaagctactagccaaagaatgtgcaggaggaacgtgccgcctgtgacctgtgatagcggcatgtacgctgagctgagattgagaaaggctgcgacgtgtaatcgagtagaagacgttgcatgcagcgtgtcctacttgcttgtaggagtaggagtacaaggagctgagtaatgttgcaacgaggtatagtaggtggcatttctagcttgcaaacaccactattcttctgcgatacccctgaactccatgaatcctgctaatgatggccatctctcgtgacgcgtgggatcactattcactcggggccgatgcacccgtcctgctccgctagccgctaaccgctagcttgtcctcataatctactgtacagtctagctattagcgagagggtagaacacgcccaacgatatatagacagccccggccggccggccgctgaagcctgaagccatgaaagagaccaaggccatgcagtgtagagcaggagctgtctagcaacgcatgaaggactaccaaggccacagcgctaccacaccgtgtggcagtggcactggcaccacgggagaggggcgaggcgactgactgataaggaagaagcaggtccgagctcgccagcagctagccgagcgcgcgtggccgag

SEQ ID NO: 12310 - DNA, 1111 bp, Zea mays
ttttctccagtagttctttatttttagttgctaaatatttcaaattatactagtagaaaacttctctccctctcacgttatagtaagtttatgttttttctcatcaaacatgatattgtttttccaatggttctaaaatccgygtacaaacagacataaatatatatgccatcaattttaaatataaccaaaattgcttgattggatgctctctagagaaatattgtaaactgtagaaataaaaaagtctaacacgcaacaaaaatcttttccacataatagccaaagtttattttaaaaaataaacagaataaaaatagaagacacatagcacaaattttacacgaaaaagtgttttggagagtccctcttgacttgccaaatgtgaggacaagaaaatataaaatatcaacttcttaaatttaccaacttcgtttatgagttccattaacgacatgttttctctctctaataactcgttaaactgagatttagaaaccttttaacataacagttggagatgctttagagcaactttagtaactttttaaaggactctataaatcaacaatttaggtagttgaactaaactctcatatccaacaactctctaaataaactttctaaatttaactactgatcatctagcttcattttgtctctatatttagcaaacattcaccaactctctgaacaaaaaactgatcataatttatatattttgttatccttttcctaatctacagtaaagatatattgacaaagtctatgtgtcagacgtcgacgatgcacggttacgatagtcagttagattttacgactgacaatgcaacattcgcacaaacgttaaccccgccagcctctccccaaacggcaatgcaaccaggtggataggactcacgttaaccccgccagcctctccccaaacggcaaaatcaccaatgcagccataactccgccccgatctatccgtcgcccctccaaaagcacgagagcgcaggaagtgagagaataaaaataataataataaggggaaataataagaaaaaaattctcgtgttcttcgaccggtggtggtggtgcgaacgcaaggcgaccaaggggaggcgag

SEQ ID NO: 12311 - DNA, 737 bp, Zea mays
cacataatgattcttacatctgacaatatgtataattgacaatatttttgcattaattaataacaaaggaagtactttttgattattatttaaccagagatggggatcctgacggggagttatcccagggagaatgggtgtgggaaagaaatgccccccgcaatcatcgtagggatccccgtggagaatatttttacattacgggaacaaggataagaagttaaaacccgacgaggaattccccattaccatctttaattaatcatctaaagatttagggttgtatcatataatctttaagaggtcttttgtatctctagattgtacatgcacttatatacattggaggtgcgagagtgtgcaaatttacctacctctctttttatgagcattttgccttttggaaatgggcgactggagacaaatatgtttgtagaattaaaacttttatgacagcccacacgaaaacgaaaagctctctccgtttccatgccttgtgacttattttttatttttttataatccatgcccttgtgagttgtgagttgtgacgcgagctgcgccacacgtggcacatcagaacccatctggctgccctgccccgggttcatcgccgtggcagccgtaggtgaggccgaagtataataaacgcgagcccaccttatcgccagtcagtcacccaccccatccaaggccctcccaaagtcccaaaggccgccgccgcccgccagcccacc

SEQ ID NO: 12312 - DNA, 1500 bp, Zea mays
tcggtacgggttgaagtaccctttgcctcctgtgtctgatggaacctgctcaatttatattaaagcagtccgaacgagggggcggacgaccttcgttccaacaaccctgccgccgacgtcgttgaccctactgcttcgacatcgtcgatcttgctacttcgactctatcgaccctactgcttgacccacgtcgtctaccaatatgtctgatgagtacacatcatctgatttgaccttatacttcagttcatctgttatgttagagatgtgcatcatttttataactacattgttaggtaaaaatactaaaacactatgctaccaatgcacacaccattgcatgactttgcaacctcgtgcctagattggatctcactactcttggttcatttgtcgtggctcaatttttgtgaatattaaaacccatttatactatgtactctttagatctgcaagtagcaagttgttcgctagattaaagccattcaaactgttgcagttgcaattcataaagacaaaatactcacaaactgatggattaaagtcgcagcgaacaggctgcaagatacaagtgtgaagttagtagtactcaaatactcaagcgccgtcaaggtctccaaaatcatggaagaaatattaaactaataaaatccctttggcctttgggcatcacgtggtgttcgaccgtgttggaggttgtggcggcggcgacgtcgtggtggtggttatcgtggaggtggcatacaaccgtgttggaggctgtggcagcgacgacgtctctgcgacggcggttagcgcgaagcagggtgctcaagttagaggccggggcggttggcgaccatggtggttatcgcagtgatgatgattgatgaagtagcattgagggatgatccattaaagaataaccgtcggatatgattgagtaagagatagtagctaaatggaatgatttggagtgttgttttttgatagagggatttgtttgggttaaaacgttggatggatttagtagggacatgactccgtgagatggttcgtggggtgtacttagtttaatttaaatcggtgggtttaagtgttagagattagagatagagattcatgaatactaaaatagttttaaaatttgtacttagtttaatttaaaccggtgggtttaagtgttagagattagagatagagattcatgaatactaaaatagttttaatttaaatacttttaaatataaaaatgaaaaagctacatacatagtagtacaggccgcacatcataaaggcctaagattactacggcccattaactcaaatttacggcccaaaatggcgaggcaggcgaaacggtgacggagctggtagttccccaaatcccgagccgcgccaccggcagcagggagaaacgccgccgcccgctcgccccgtgcactgctcctccgccttagcccgtagccaccagatccttggcgcaccagccctccatcgcagtcctggttaggctagggg

SEQ ID NO: 12313 - DNA, 71 bp, Zea mays
atttctttctttcattcttttgtttctgtggagatggataccggcctgtagttaattaaccaatataaact

SEQ ID NO: 12314 - DNA, 140 bp, Zea mays
agtatggtaacacagacactttatattagtcattatttacttgaaaattgaaatactcaacagatttttcttttatcctggaataggatgctactcaaaaccacttgagtttggtgaacaaagatgagaaccagcaaact

SEQ ID NO: 12315 - DNA, 1163 bp, Zea mays
gactccgctaagcgccgtgcctcccgggccccaccgtaaccaaagatttggcagcgaccgtacgtgacgtgggcccagcagaggaaacggggggaaggagggagtagattactctcgctaaccagccgcgcgcatcccctcccatttttatctgcttcgcttcgcttcgcttaaaccagctcgaccttcgcttttgcggcggagaacataactttgctattagcttgttcgctgcggcttgctgcggctgcaatccggctgcggctgcggcttctacagtatttttctatttatggattgcagctgcagcaatccaaacagctgcaacagtgtcggcttgcagccagccgaacacgcccatatatatacaatctcctcttgctgctctccactcggaccactcccactcttcaagcccacacagagctctgcacaagaaaaggggaggaaggacgagccggagccactcagccgccacctcaccccccccatcggccgcctgcgtcccaccacccgctcctgctgccgggcctgccgcccgttgctctcgccaatgaagcctttgcggccgcttcggcttccgccggtttgtttgcctccttgccggctgcctcccgggtacgcctgtcagcttgtgacgccgtcggttcttgccccgttcttggcatgcttttcatctggttcggccgatgcgttcttgctgggaggcccttgatttgttctgggtgtctcgggttcttctcctccgtactagtggcagtgtgtgtgggttagcgccaccatttgctcgatttggcgttccttcgctctctgccggcagcagatttacattcacatcctctctccttcggtcccttgtttcttgcttggtttgttgccttcggttcgcggctttacctcgcgttggtgctcctttttaaccgactcatgcttcggctcacgaagatttccgcgcctattgtgtctgcccacccccctgcgtggcattcacgcaccttcttgtttgtttgctttaatgagctgcatgataagcgagcggatcctgatgtatccccccttgtctccgtcgcagatgagaagcggcgcaacctgggcagcggaagcgtggtcggcctgagccttcgccggggtttctgccgagaaggatcctggagattaagcgc

SEQ ID NO: 12316 - DNA, 591 bp, Zea mays
tgtgggttagtggttagcatcctaaattaagccaccttatagtccttagtttgaaccatctactatttgcacttctactatcaggatttgcttattcattcttaagttttccaaaataatttggactcaaaatccttttgaagcttatcaaaggattactttaatatccatgttaatgggggatcgctctgataccaatctgtgggagccctcccaagttatcgggcccacgtgcaccaatccttaccttgatggcctcagatggctatgcacgtgtaccaggtaacttaacaaggctatcacgagttcaacaacttgaactcatcatcccaaggatctcccaccatacatgcatattacagtaatcacattcgatacacacacacttcagagataagagcggaagactttgaactagatttaccccgacgagcatgttattgagattttaggtgcatatattgcctgcgcaacggacaccgttcctggcagtgctccgggaggggtagtaagacacctccaacccccaagtgccaagctccacgcctcgataacgtcaactttccaccgctcgtgctcgctgccccgtcc

SEQ ID NO: 12317 - DNA, 1500 bp, Zea mays
gaccgacagagcttagatgctggcgtcgacggtcgaaagcgggtgcgttatgcgtgcatcggtcttgcccaaatagtagggttaggacttagaaattagttttttttactgtgggtctctagttgggctgggacaaggtgttgctcgagcaacgcctccgctcttgcttaccggcaaatgcatcttcaagagatgagaccatacttttgctcagtaattttaagaacgggtttggtgaccagagaattgaagaggattcatgtggaagaatcctcttgcacaccatacaaagccctgtcacgccatgaaagggaaaatatgcaccaacaaacaacccgtacatatacaatagcggtcctaatccacaacaacaaagaatactacctccttttacaaatatatgataatattgaccttttttctaaaaaaactttcaccactcatcttattcaaaatatttattcaaaaatgtaacattttaagtcatgttcaaatgacctccaatgataaaaataaattataaaaaaataaacaacaactcacgatttttttaaataagataagtaattaaagttttttaaagtcaacgacaaaatatatttgtgaactcatggactatatttcaactcgatagtcggccattgtttgttttcggtcacgtaattctaaaaccgtatatattttgttcatcaaacttttaacacatgaaagtttacccttcgagtaggtaaatttaagatggttttatgtttataaaaaagtaaaagaccatttaaaaatcatatttatttatgtttaaatcagaaaacacgacaattttctccctaaatatgaaacgtgcacctacggcccaaacagcatggaacggaacggggacgtagaggcccacctcatggaaatattttcacttgtccattagaaaggcccgatgagatccgcccactcaacggcccatcaattccgtcaccagaatggtgagatctcggccgtccaagctagggctcgcgcctcctctcctccgacccctataagcacccaaccctagcgcaaaaccccgcctccgctggacaccccgctccgcctccactcctcgcgccgctgccgcatctcctctacaggtaagaccttttgctcgtcggcttcctacctcctgggcttcgttctgtgctgcgtgtgggttcgttgcccgtctgatctcggttgttaatcgactgcttagccgtggcctgtgggatgcgcacgcggatcttgctgcgcgacggctctgggttcctcttgatccgtttcctagcgctgaccataggatctggtgtgctctcgatgcgtttgtgtgcattggtgttgcaacttgctcgaggcgctgctaacgagagcatagggtggagctggcggcagctcgttgattcttgttcccgtggtgtgctcgttgctcgtctctgctgatgccgtcactgttgcgttgttgatgtgtacaggtaagaaggagagaaagagggcgaa

SEQ ID NO: 12318 - DNA, 49 bp, Zea mays
gagaaaacaactatgctcccatatctggccccgtcgtcatgggaacgcc

SEQ ID NO: 12319 - DNA, 368 bp, Zea mays
ccagaggcccgggaaaaactgggccaagtccaggccctgtagacaagtcaaaagacaaaatacacatccgggcacatcccacccaatcgacgtgccggatcaaacacgccccccctccaaaagaaaaaaaaacaaaaaagccgaacaaaaaacacgacgcggcacagaacatagcaccgcaccaccgcaccgggcctcctccgagtctccgacctcctcctgtcttcggtgtcgtcgcccgcctccccatgaggccgccctcgagacatgcctcgtagcctcggcgtcagtagcagcagcagcaccaggcgctccctccgcgtcgcgccccccgcctcacccccgctgcggcggccgccgtcgccggc

SEQ ID NO: 12320 - DNA, 924 bp, Zea mays
ggtaagtgagctcagatcaaacaatcgaatgttttccttaaacaaaaccttatctggtcgtgcgcactgcgtgatgccatcgcgagcgatctttttcaccggtaagtttggcgtcagaaggaaccacctaatagttctttcggggagcatcacaatgtttttactttattacactacggacactttggattctagctgttaccttcatctctgtatccttcgtcgtccaggctctaaaagaagcccgtttttgaagaacgtgtctacctttttctgaatgttcaaagtagcattgaaacatgttttgggtattatttttacgagattaatgttacgaatggtaaaagtaggaaacgttttgtttgaaaaatgtaaatttctcgtgaaagaagcccgtttcgagtgttttgagctcttcctacactcgatttttttccacatcttttgcctcctcccgatcccgacacgccgccgccgcccaccgtcccgccgtggcgcggtagaatctcgccggagctccgacgataccttaccgccccaatggcagcctccctcttccccttcccccaccattgtcatggccgtgctcgcccccgacctaacctggcccggccacctccgcccgctctggcggcaccgccgcctccgcctcgccgccgtctccaccgcctggcctgtttgtccccccaaaatttattctaagccagccagagatggagaagaaaggagagagagtagaaaataatcgagacgtagcttttctgttttttaatgccgttggactggactgtgtttctgcgttagattgtatcgtcacttgttttatctacgatatgattcgattcatggattgatccaatggtgctggtgattcttgctgcaatttgcagggacggacagctaaagtagctgtggttgtgggat

SEQ ID NO: 12321 - DNA, 1449 bp, Zea mays
tttatctcttaattttttttaatttttttgaatctataatttttttgcgggttaaaattacgaggatgataatttaaatattttttgagttttggacaatagttcatgaaggtagaatgacttattcctattgtaaaaaaaatcatgggttaattgttatgcataaagcccacgatgggattttaggcccaaaagcggccacttcgcagcttatccgaacccagtcagccagcccacgcatgagctatataagacggccatataagaaaccctagcggagccaccagcacactcgtctttttcctctacggccgccaccatcgcctcgcggccgcctgccgctccgctcgaaaggtgtggcaaccgtcgaaattttcttcacttcgtttctgcctttgaccagctcttgcgctcggcttatctcgtgcggttgttgctagaaccgtccctaattccattcccgtgatctggtttagtcatttcatggttttatttgttgcatctgtggtgaatctgtggtcacttagatcaacataggaagatgtacgcccagttgagttttgagttggctgttggtgtttccctaactagggattgagggtctgaagctctatacctgttgcaatcgcgtagttgtgcgtgctagatgtatcagagaatccctttgagtagaaagcacacgcacacagctgccacggtattggcattcgtaggtatctgtttcactgatgtgctacatgcacgaggatagcacctgatatttgtgcgcttgtaagtttacttggttgcttaattgcttattttttagattttgtacttgcatggttacattgtcatcttttttattgcacatgttgtcattgtcttgcaagcagatagtcatcaggaggtatatgtccagttgacttgagttggctatgcatgttttgatttcggtgtcaaggcacatgtactgtggtgatatagctgtttcaatagcgtagttgccaaactttttgtgtgtgctatatggaccagggaacccgctttgcagcagatatttgttctgtgtttctgctgccagtagtcacccgacagttaaatccttttgagttctgaattctattggccctttaggtgtttgtggcatgctttcgaattggaagcccatgcactttgttgcaatgcctttggtattgcatagattcctatttcattgatgtgcaagatgcaccagtatataacccttgcagcaagaatttatttttggctgtgtttctgctgcctgtcaaatcctggtttttgtgtggatgcaaacttgccatgttgattaatacattgttactgattttccaggttttgtatttgcatagctgcattgtcaaatgtacatatgaattcttctgattttctttatttggtttgtgtgaattacacagtttttagtgaagattttttgaagccgagaag

SEQ ID NO: 12322 - DNA, 1500 bp, Zea mays
cccgaatggccgtccttttcgcgccgtgcacgcggacaacagtggcaccggaggtcgccttcacggtgcggccgcgcacctgggtgtcctccggatgcagcaggttggttgtcgtcgttcaataacaatcgagggcttgttcggttattttcaatccatatggattgaaggggattgatacggattgaaggggattttgacttaatagggattgaatccccctcaatccctctcaatccatatggattggggtagaaccgaacatagttgggcccgtctgcacgagggtgagggtggaacgggggttaggctggaaagcacgcctaacaataatggatatacgtatttattagtagaatcatggcgctctaaacccgctcctgctccatgtcttaatcggtggataaggataagcttaaccgtaatgcacgtagcactgtagcgacccgtcacccgttcttgacttgtcaactacatgccccatcctttctgggagtgctgtcttttttttactgtaaagaacggtctatgtgagcgataacaacagcaaccttttgtgatccgtgtaagaaaaatataatcacacatttcccccctttattgtccaaccaaaagctatcctttcttttagataaaatacccattttgccctgccgcactaggtgctatggtagtgatggagatgggccaaaccttttgaacaaagtaaaaacctaacggaaaaaaatgatccgttcgtcctagttgttttctaactgaccagcagtcaatatttaccacactggtgactaataataagatgagtttttttaacttgattttcaaagcgagtaccaaaaacgacccggcctgctcgctcgtgtttctctagatgtacgtgttgttctatggacttttgcagtgcagagtgaaaatccgcacttgattcacaaagtctttattttaaaaaaaattgtattttagtttcctgaaacagtacagggaatagtgttttggacgaacgcatttggctcgaaattggaacaagagtccttcgtgtacctactttttataggttgaccccaaataaacaactccatacataactataccttcacaattcgtcaagcaaaactatactaaaccccttcaattagcaattaatctttcctgccactagtgagtctccgacgtcccatcgatgctgacttttccgccttccctcggcgccgttttccgtcctccgctttccgtcggttttttttaacatgttttcaaatcttttaggccgcacgctgctatcctcatcagtcttctccgcttttccccccatctccttctgggcgcaccaggaaaaaaattgatacattcctcggcagctgcgcgagtcctctgttgatacccccggcgacccaaagcccccgtccgagcagcagcagcagcagcctaacaggattggggatttttttttgcttcgtgttctccttctcctgctgtaggcgttgattcgggtgatgagag

SEQ ID NO: 12323 - DNA, 526 bp, Zea mays
aaaaatgaaattttataccctaaatttaaagtgttaagatttatacagcgttcggaaggcctcaagcgttaaagtggattgggcccggcgacaacctctgtcccacgcgtcggcgtcggtgctgatgtcgcgtggagactggagagcagaatggtggactacacattctgtccgcggtgcccacgtcgatgaggtgaagtgaagcaaccagcaaccaagcagctctgtttcgcgctcccttccggtccaaaccaaaccgtgcgtccgtgtgcgactgcgacgagaagcttccagaacccaccagctaactacgtccgtcctccaccaatcccatcttcggacgccacgacaactcccctccctcttccccgtccgtatttatttatacacccccagtccctacccacttgttccttcttgcttctccatcgagttggattgggttcaaagttgggcttttggacagctgtggtgtgcacggcagctctgtgacttgtgaggaggaagggaggaagaaagcggatcc

SEQ ID NO: 12324 - DNA, 695 bp, Zea mays
aatatgttatttattcttggtattctttaacgttttatattttatatttcatttcgcattgttttatttctgaacacgaaggtatgaccttcgtgatttatcttccattaccttcgtccgaagctcattaaatcctcaaggaaataatgtttcagcggacgaagggctttaacatttaacattctatgttgtcttgttcttaattcatagcatttgagaacaagttcccaacactatctatgccaacaagctattagctctagtgcattcaaatatctcttaactaattaatgtatgtttagtctaaaacaaattatatttggtatggaggagtaataaatggatataactataaagatgaccggatgagcacgaaggcccgacgcttcgtcgcctttacatacttgtggtggatctcatcattgacgtgcatatctttgatgaaagcattggcgtaccaaccggaggcgacgacgatgacgatgactatgcgggtcttccaattcccatcaagagacaataaagcaggagcaggatcattgctaattcttttctgaagtaaatattaccgtcatcttctctttcttctcttacaaatatgagtcgtttgttcgtccaagtactgccactgcacaatatcagcttcgtccttccttcttctctcaagtttcacacaggttataaaaactcttcaa

SEQ ID NO: 12325 - DNA, 1099 bp, Zea mays
ggtatacacgccatattcctacgactaccatcgctcctagttcagtaacgttagatcttctgttataactttaattcgatactaacatcataccatggctagtcatatggggctcaaccttcagtacagtattccaatggcaattggaatgtaaccttgagtatatattatgcagtgtcacttatatctgataatctgttgagtagtcaatgtgcaatttgattatcttgtttataataagtggtatataagtttatgtttcttccatgatgggcaactttaagagcatttatatatcctttcaaattctgatagtgtgctgtgtcatcaagatgtgattttattggctcgtgtcaataagtggtatataagttatgttcattgctggatgaagcattaatagagcaacgaatgatatttttttgaaattcctcttagctttatgagccaatatattttgcgtacggatgcaactgtagaaagtgagtaatgtttgatgactgactatgtgatctgaataatgttacttctcattgttgtgcaaaatcaaggtgaagtgtttgttgttaatgttttttcgtcaatctgatcatatatgatattaagcatttgcaagatacctgataaccctctccatgcagagctcaagtctgaaagagcactaatatttgcagcccaggtttaggttttaggattataaggtgtatgcaagcattagccagttgttgggcctgtttggttcctggctaactgtgccacaacttgcataaggttagctggccaaattgaatcattaaccttaggcaaaaaaaagttagtcgaattatggcaagttagataacgaaccaaacaggcctgtcatctttcaattgctatgactatgacatcgcacaaaatggtggtatacaatcagtttctgaatgtttgacacgtgtccaagtgacatttgaaattgcatggcatatttctttgagtgattgctcttttgtgttggttttttaatcatagatggcctgacattttgctctgtctgtcctgcagctctctctgaagaccgagagggaaaagaagcgtgagaagtacttccccatgaggaagt

SEQ ID NO: 12326 - DNA, 94 bp, Zea mays
ggttagtatgtaactggtaccttcgaggttgttggtggggtttgtgccgacaaggaaaaaaatttagcagcttgcggagacaaaaacaaggagc

SEQ ID NO: 12327 - DNA, 1500 bp, Zea mays
ctagatttataaaaaagtattaatatcatttatatctctaaatatgtttattatgaaatatattcaaagatccatctagtgatactaattatatactataaatattaacatttcacatatatttgattaaagttaaaaatggacgtctcttagaaaagtgttttctatcaaagttaaaaatagtccttaaaaagcgagagcgtcaactattttgagatggagaaagtacacattataaatattagttttttatatatctagttaaatgtttaaaatttagattcacaaaaaaaatgagaggcacattgtttgtaaggtactctatctccaaagtaatggagatcaaatattttgagtcatgaaaaacaagatattgttttcatatgtttgattaaaattcaacatagtagacttctaaaaaagttagattgtcaactattttaagacagaaaaagtgtacatcataaatattgggtttttgtgtccagttaagttttagaatttttgactcaccaaaaaagaagaggtacattatttggacggtacttcatctccaaggttatacagatctggtctctgatgtggtcgttctagatgtctgatgtctccatgtgcttatagatctgatgtctccatgtgcttatagatctgagcacctgcagatctgaacaatacagataagcttcaccctatgatgagacgtttgaaggaaagaattcataattaagaaattaatataattcgtcgttttttattttctgttatttaaacgaataattcgtcaagtgtgttaaaaaacaaagatttgtgaagtttgttcggcttccctttcaacatcctggaagaagtgcccccctgtatggtgaaattatgtcattttataatctaatattatacgaagagcggagacaatcaataaaaaaatcttaaaagttttttggtagatagtttatatggatattattgtaagccgtcacaatgcacgagcaacccactaatttattatctattttaggctagatgttcaatggatacaagctattttatgtctgaaacaaattttttatagattctgaacctctgatacattattttagtctgtatctttgtaccttaacatgcatcaaagtcttcccagacgcggcggatgctcgccccaccttccctaatgcattcgccattcggcattcgcaaaaaaaaaatgggaatttggtcacacgattcggacgtctgtgcagcgcgacgaagggcttccaagcgtgtacatttgcaatggccaatgaccaatcgaagaatcacacaccctttttcagctatgcttttccctctcctagtgccgcagatttggaatcaatttcatggccagaagttaacagcaaagctaacacggaaaacaaagcgtggtaaagcagcacctatgaggcaacgaatctcacaccatcgttttcaccggcccacttcgccgtccggctgacctgctcacctttcctcttcatgcaa

SEQ ID NO: 12328 - DNA, 468 bp, Zea mays
tgcatgcctgcagcatcggtcgttccttccacaccgacttccaggacttcaccatgcaagcttgaggggaggaagtctcgccaaatgatcgcgagcgggattctgctggttggaagcatcgtttgtctatctcgaggccgatccaacctcggggcgcagctcgcgatggccttcttcctgaaaaaggccttcaagcaagagaggcaatcaagctcctcatcgacatgaatggtgaaaacaaacgtgactagatgcaggcggtagccgtactggtttgagccgtgcagactccagacaacgtattattagcatttttaacctttctctgattacagaatacgtgactagataacctttgaccctgagccgtgcagacaagttgtaaagagttttttccggaactagttttgtaaataatcgttttcaaatctggaaacatagaattactttgagaatggaagaccgtgc

SEQ ID NO: 12329 - DNA, 1497 bp, Zea mays
catccaccgcccttcacccgctcttctttgcgaggtttgttttggttagatcactctttgtattgttcttctgtctattggacatgtcttgcctcttcgaattccattctgcctatcttacctcttcgaattcctgcgtttagggtacatgtttcatccagatctgacccctatatatggttgccttgttttacttgtgcgctgctgatgcatgcttatgccagccctgtaattgtgcctaagctccagaacatagatcagatacgtttaggactcgtaatggatcgtggctaaatatggggttagttgctccgtggagcaaaccggatgtgatccatagaaccaaatgagtactccagaagcaccggtctgtccatacatgtaatccagcttcaacccagtgctccaatggatcggctgggtctattgtatgatgagctagcggtgtggcgctacatgctccgatcgaagccatctgccggcctgggtccattgttgattggatgtagcaatttgcccacataattgtctttatagatttctaagagctgttgccttcctgcaataccttgagcgattgtttatacacatgctttatggtttttaaccacacaagtagaacaatcgaattgagaattgaactgacgaatacatattttcttggctatgccgcagttccatggattgtcaaagcttaaccagcaagaacctgatgctgtgcaaggcaacaacctttgaacacaagtccacaaactacaaaaaacaacaatgatttgccattagtgtaagatcacaaactgaaaaacagaacacaactaaggttcaccaacacataattcttttctcacgaacactaatatactaacaaacacagttattgcactgcattcatcagtaacgagactatattttgcataattattttggagataaatattcgtcagcctggagaatgcaagggatccttgatgttcacatgctgtcaactagcatcacaatctttaaaagatatttgagatcctctacttctcacggatgcaacttactaggttgctcctcattcaatgcaaattggatcacctttcttttctcctcctgccagtaagcatacacatgttatcatcaccgacgaatgtaggatctgtgtgactttgtaagcataagaaagcaaaatgattgctttttttgtttcatcatgaacgaccaactgcatcaatgctacatgctgtaggtatttcttagctatatttcmaaaatatrgaatatcaaatatgtgatactcactattggcagccaacatcatgttgtgttctcacagttgcagtagtgaatgcaaatattgtaatctgaacccctttcactgtcatgcagagtgtgttaagacaagatggtggcgaatgacgacgcacctgctagagggagtgtggcggcagctgcaagcctgcgcaagcataggaccacaagcgctgctgctgctggcggaggtggtgccagctg

SEQ ID NO: 12330 - DNA, 424 bp, Zea mays
gataaacaacwggactactcagattatataatccaaattatataattcagattatataatcctccaaaaataatccagattatataatacattggggtaaacaaacaggcccttaaaataggaccatgtttagagcctctcttggagatgctcttagaatgcgctgctttttgtcccgggccgatggggcgaccgagcgagcgagaacgcggtttcatcacaggggtctggtggctgggtggctgggtgtgaaagggccgtgcgggaagctaaccaccgcgaaagcgcctctgggggagtcagacgaacgaagcaatccaaccgaacgaaccgacctaggtcgtcgtcggctcgtcccctccgcaggaccggttcgccgtctcgtcccgatctcgccgcctgcccgccgcgccctattaccgcc

SEQ ID NO: 12331 - DNA, 1173 bp, Zea mays
ggtaaacatagataaattgaaactggggcctcacagttaaataggcctgtcagagtctcagttgggctttaacaaataatggccgcatgggccagttaaaaaaactaaatatataaaaaatggggtgttgcgagaatcgaactcgcgacctctcgcacccgaagcgagaatcatgccactagaccaaacacccaatttatggtaattatactatcattatacatattatataatattcaggatctgacgaggaaatgtccgagttctatggataccgtgtgtgtttggaacaaagtactactgttttacatgatgagtaagcatgtagagtatttcgattgtattggaatgggaaaatataaacaaaatgtcccaagcagatccgcaagagtccagagagaggctcggccactgcaggcgggccccacctgagcaaagacaggcgaccatttcctttccttcacctcactggctcgctcgctcgcctttctctccgtgcggcgaccacggactgggcaaccgccaccgccctccctttccctgcgctagcgacgactgggcgaacgctgcctcgcttcgtcacctcttcgccggcggcgacgatcacccaccaggtatgcccgctcccttctctccccttccttcccgaagccgaccaccccaaaccctaagctatctgaacccggatctgaccatgattcctactagcttcgagtttttgccaaaaaaaaaaaaaaaawtcatcgggtgcacacatcctgggttccctcctttgtgcatccgtgccgctgttgattagcactagagctgcaggctgctgtagactatacttcggatgtaatcaatgtatgcttaggtttcacgtggtccttgcttcgctttgggaccactctctagtcagtaccatgtgtctgtgatatgtgtgcaacagggaagcttgtcaatctgggaaatctacctgcatatatagagggaagggaattggatagctttgatctttgaaccatccatacgttggccggacaacacaggctgaactactaccatcaaatctgtatctcttgttctaaaaatttgcgagctgaaccgagtagttgctttgcaggttgatgccgattttttggttgacaatttgaagattactaacttctatgatcctgagggcaagaagta

SEQ ID NO: 12332 - DNA, 424 bp, Zea mays; identical to SEQ ID NO: 12330

SEQ ID NO: 12333 - DNA, 469 bp, Zea mays
aatggagagagtaggtaggtcggtaggttgcatgcacacgtttcaagcagcgtttggaccggccagaagagctgtgctatcaaatcaaaatcagacaggcaacgaggcagtgggccactcctatcatgcagcatggaaccaagaagctactagctagatctccttctccagtgagtcgctcaataaatccgaaagctcagcggtttgattgtatttctttcttttcgagttcaacaagtatttgtgcacagatttccctatatataccataacatcctcaccactttttctcccccgccgcgccggcttcatcactctttcttcctcttcttcttcttcttcacacaagcgtgctccttctgctcttgtgctaagtagctagctcacaacagaagaggacgagagaaagcaaggcggcggcggcggcggctgcggcagcaacaacatacaccgccggccgcgtggcgcc

SEQ ID NO: 12334 - DNA, 1173 bp, Zea mays; identical to SEQ ID NO: 12331

SEQ ID NO: 12335 - DNA, 307 bp, Zea mays
catctttgagacgttccgcctcggcctccctggcgtgcgctggttcgtcatgggcgacgacgacaccgtcttcttcccggacaacctcctcaccgtgctcaacaagttcgaccaccgccagccctactacatcggctccctctccgagagccacctgcagaacatctacttttcctacgggatggcatacggcggtggcggcttcgccatcagccggccgctggccgaggcgctcgtgcggatgtaggatggcagcctccgccggtacccggtgctgtacggtagcgacgaccggatccaggcgtgc

SEQ ID NO: 12336 - DNA, 322 bp, Zea mays
gggtctgggaatgtttcgccggtcttcgaattgcataggaaacttcgttcgaacgcattctggaatttgactacgagctatatwtgtttaagattttactgccagaatgctgggaagtcgctgagaaaaaaaaaattgcaatctcacgcgtcgagcgactagggtttgaaaatcccttttgtttgtagagcttctgttttccttccactgaaactccttcgttcctatccatcaattgcagagtcgatgaaggaattgctcgaatcgaggcctggattgacgggtgtttgaggctcggtgaccgaggagcgccgcttcagat

SEQ ID NO: 12337 - DNA, 1500 bp, Zea mays
atgtctgtacacgtacgggttaccggatcgatgaccagctagctagggtgagcaggtacaagacgtcgtgtttttttctcacccatggacgttatggcggcggccagagccaacgtccggtgatacccagtgtagtgtagcgccctttaccagctcattattgggcgagaaaccagcgtgcatgaaattcggtaaaaagagacgaaaaggcctgcgaaaaagagaggagagcaaaaaaaaaaaaactaaagtagtaaaagcttggagcgagtctacagcgtacgggtaccgggtacgtacgtactacgtagagctgcttttgctctagccaccggacatgtggatcccagtccaaagcgtcatcaatggagcacgtagtacgtacgtactcactgcagctgatataggcctttttagatcttatggctaattgtttacttgtgcctaataattagccggcaaataattagttagtaacattaagttaggctatgtttggagtcttgactaataatttttttatattagcacctattagctaggccagatagcacctattagcagcgggcgggacagtatgtacgccaacaacacacaagagcgggcgggcagggcaagcacgtcgccgtccccaggaccaggaggaggaccacctgtggactccgcccgcctctgcgtctctcgttgttctagagaagccaaactcctatgaagaaaaaaaaaactcgaggaaatccagaggcggagatggcgtcgcacaacaccactcccgtctcccttctccgctcccccaccaggccaccacttgatgccctgacgccgactgatgccggagagctagctagcgttgcgttgcgttgcatgcgttgcaccaccagacaagacacgaccgagctagcttgcagctattcctatatagcaatatagcatggaggattttctctaaaaaaacaaaaaaatacagatttatttatattctatctgcgtgcacgaatttgtactagctagctagctaatacccattctatcaacagatatgtgagtagagaagagacgaggctagctaggagaggagactattatagctatagctagctatattaccactgcatgcagatgcaaaagcagcccggccagggcccaggggcacaaccagcagactgcaactgccactgcatgcagctgtacttggtggcgagagggggggagcttttaagcgagcctagtcgtgtctcctctcctctcccctcccctcctccgtgctgctccgcccctcgatcggctggctctactttgcatggtccccggccgggcctcctcttgcgtgctctccgacctcagtcacggcgcccatcacggccccttaaaaccgcatactacacagaaacatataccaccaagcttgctagcttgtcgcctcacaagctacggcgagctactaggcgaagtagaattattcctggggccgcgcggcagctagctcctagctcgcagccggcc

SEQ ID NO: 12338 - DNA, 1319 bp, Zea mays
attgaaatttcaggagaacactgaaagggaaatgtgtccttgggcaatttctataatgtttggtgattaagtgcccaacacgtttaattaagttcttatgtgccaaataaagtgagaagtgcaaatcaaggcaaaaggtatgtttctagacttggtaaattgtttcatgtactaacatggttatctaagtgctagaaacagtgactaaagaagaagagaggaaaagggaagggctttgctctgtgcagccaagcttcagctcagtctggcacatcggactgtccagtgcgccaggctggttcgcggtgaactcgccgctctcgggattcgacggtgacgtacgactataattcaccggactgttcggtgagccaacggtcgccagcgccaacggtcaaccgcacaatcttcgcgcgacacgtggttgcgccaacggtcggttgggcacaccggacagtccagtgtgcaccgaactgtccgatgtgcaccggacagtgtccggtgctccaaccgatcccaaggaccaacggtcggctgttcttcgtatggaaagaaatcatgcaccagacatgaacagttgttgtccggtggtgcaccggactgtctagtgcaccacacgaaagaaggcaagattgaccttccaagttggcctccaacggctcctagctgccttggggctataaaagggacccctaggcgcatagaggagacatctaagcattcactaagcattctaagactcccacacttcgcctccgcgcatttgatcgattgtgttagttatttgagctctgtttgagttgtgaactctttgtgctacgtttcgagctcaagtcttggcttatgtgcgtgtgtgtgctgtggatttgtgtgttgtgtgttgctctcctagccttactcttgtgccttctttgtgatctttattgtaaggcgagaggctccaacttgtggagattcctcgcaaacgggagaaagactataaggaagaaagccatggtattcaagttgatcattggatcacttgaaagaggttgagtgcaaccctcgtccattggaacgccacaacatggaagtaggaaagtgtcacttggccgaaccacgggataaaaatcgtgtgtctcttgtgttgctttctctgtgattattgtgttcacaagaactcgcttcaaagctacttagtcgcactaacacttctataactaagttttgtggctatttagtgtttgattttataggatcacctattcaccccccctctaggtgctctcaattggtatcagagctgtactcttcatctaagggactaaccgccctaagag

SEQ ID NO: 12339 - DNA, 1355 bp, Zea mays
ggcgcgtctatattcgtattactgcttttggcgtcagttggataaaaatgtaataaatgctaagatgaccggttacaatatccatatgtcccgtaagaatctttacatttaatgaagggtattcttctaatctctcatgctactacttattaaaatagggatcgttaaacttaaatttttatactcggttagaaacacggtctatctcgaccattagcaccgcagtacatgttgctaagagtaaagtttacaattgagatcctcatttttaataaaatacaaaaggacaattaaaaaataaaattagctcaacaatttcaatttaactcgtggaaaactaactaaatactagctctgccactgaaattgatgaagaggagggagcaccgccgggctggcggttgactccggtgaagaaccagttggcgcgcaagctggatgagtctgtacaacggctcgtatttgctggatcacgtgtgctgtatttggtaccgcttctccagtctccagagaaaacgcttatttttatcgttacactattcggaatttcggatctgaatgtgcaagttagaacagaacatctgggttaaccattgtgggccctaaaaagtctttttataataccggaccttggaagcatgctagccagaagcccactgggccgtgtgctctctagtccatgcgccatttcgtttgtgtcgactttaataatttttgtcattctctcagattattttcctgagagcattgtgcgtatatttatactaattacgtttgaggatgctgttagaaattttaaattcaaacgttgtaaatttaacttaattattcaaaaaaatatgtataaggtaccaagatataacgtcacatgtctttcagcaatacagttcttctaagttttataaaaaatcaacgaagtcccacaggattacgcgatcattggatgcgtacaaaaatagtgtccgtccccaacatctttagctgaaaatgatggcaaagagcacaaatccaggaaaacctagtcgaaacagaatctccatgtatatcagtatacataaacattttcaatgatactatagaatattgataataaactcatttttgaattgaccattccatttgaattaaaaaaaattatgtcacagttgccaccacactgtttccttattgtctactcaccccattatgagccaccttccttttttttcatttgctataataattccagcgcctcttattatatttttttaactcgctatttctgctcacctcctcctctccttttcttcctccctcagcctggcctcaactcccctcccatcccgtcccccgatctcatctcgccggcggcggcg

SEQ ID NO: 12340 - DNA, 179 bp, Zea mays
caaggcgataagggaaatgctgataaggccggccacttttctgttatccaccacccttcctatcttaaaaggaggagaaaacggaaagagagagagagagagagagagagagagagagagagagagagagagagagagagagagagagagagagagagaacctctctgcaggtgcagcc

SEQ ID NO: 12341 - DNA, 484 bp, Zea mays
gatcaaggttttggattctggcaccttgtgttataaaattcacttgagtatagaatctctattttttgttgtaagaaaaaaattctcttttttgttagaaaaggacgtgactttggaaatgaaggcttctataacagtgggtatgaattgcttttgatataccagttgcaattgtagcggtttccttgtctggtagtataccagagctggccagtaagctaagctacttgtttgagtaacatttcaaaatttacttgaagtgttttatcatctgatgacaaagagaatgaagggatgaaagaacattagcaccatggttttggttggtcttgtaaacagaacctaattttaaaacgccactttatcgcgcaagagcagagcaacagtgcaaataaacccgcgcgcaggacggcaggagcagtcgcagccttgctttccttatccaaaaatctgctgccgtccgtcggggtgccggtgacacgcg

SEQ ID NO: 12342 - DNA, 1253 bp, Zea mays
gtgaaattagcgatgagcgtgtagcgattaggccctggactgatatagaatagtgagattagcgatgagcccatgcggtcaagaaaataaggcgtcagcgaattcaaacctccccggaatctctgttcaaattttgatctcctggctcctgccacctgctttccaaaaagaaaaaaatctgatccgaaatagagcrggctacaatactccgggtagctggcttctccgttgtttatagtgtattattgttttgtgatgagctttgcttaaacaagctacttggaagcagtcctataagctgagacaatgttcttccatttccgcggctatatcttttagctcgcattattcgagagcagttggggagatgtggcctcaagtggcgggatgccattgacctcgatccatccccctcaacatgtgcgtccgcagcctagctatatacaccatctcgccctccaggcccatcatcacccccagcacccaccccacctgcccacttcgtcttcctcctctctgtcacctcgccacccttcttcttgcgttctccatcgcattgcatctgtagcacgcagttctccctggtcttcttccgcacgcgtctctccccgttctgccagtcctagttgaaccagagaggctgttcttgtgcgtgtgagagagagagctggacaccgtcgccccacccattacgccgtagccaaacctggagaaaaacctgtgaagcatgtaactccagtccctgtccaaaatccaaacccaagccccccaaaaaaaatcacaaaaaaaaaaacaccttcaagatcgttctccaaaagctagcaccggtaatcagcggcgaggcgtaagtcggtaggctggatacgcccccactaattccttagcacaaaatcaacaaaagcctccggatcatgtaagtttcgccaccatcatctttgctcgccgcccagctaaaaaaacaaaaaaaaaataagaaacccagcagcatgcatcgtcattagtagccatcagtcgtagcctatcgatcgtcctgggagccatcccagcattatcgtagcattacctcagcaaaaaccatcaaatcatgtaattagtgtgctcccgcgtcctatttctgctgcactgccggcagtcgaaaaaaaaaccaaaaaaaaaagattgtccttgagagtgagtgagagagcaagcaggttgctagctgctggtagagagagctagcagttacagccgaccaggtagctagatagctagcc

SEQ ID NO: 12343 - DNA, 1500 bp, Zea mays
gctcgatgcactttaattactttctgttaactgtaaaactgtactgtcattaaaaagtgtaagaaattgtgtaattactttttctctttatgaattatctttatgaggtctgaactgttgatttcgtatgttctaaagaagaatgtcatactcagttgtcttaccctggtttatttatttacctcacacagttttcttgctctcgtttggaccattgcgtatgctaaccttttacaccttttattttcctttataatttatgttcacacatgctaatcaagctaatttatttactttaataattaactataattggtttttgcagcaagaatcttaaagtgaaatttgttgtaaccactgatgtttcaagtttacctgaaaatgtcgttgaaatggaggaacaagttaaacgtaagaattggcagaaggaaatggttcttgaagatatgaaaagggaggaagatctgctgaaacaagttaaggaattatacagaaagcagaagcaagagctcatggattatgtcactcaaccagcagtgacacaggtatgtatacgtgaacaatttattccctttagaacataatattgacgcctatactagtgtagtatagcttcctgtgtaataggccaaatttcatggagatctgaataatatttgatgattataagtttttttaacaaactagcacagttgtgcctaaagcctccctatcctctttcctatttcaaactcccacataaacaccttgctggaaacaatgttttgcactcccacatacacgccttgctagagatggcctgatagagaaagggcgatttctttcctgatattatctatacgtaacttgacctactgtcatttctcttctcgcagacgtcatgtgaatcgccagcaactcattcacccgcaactcctgggagtaatccgtttggagccaagctctccaacaagtggcggtaacattttggtggcgtacgtccctattttgttggggcttattgcctgttctggcatcagcacgacataactagcttttgccacaagcttggtgttagtttgtgagggtgataggccagtgaaattgttctgctgcttagcatagttggatgccaattgatgtatagggttagaatgctttttagcttttcctatgctaatcaaattgccaactgctaatcttgattcttggctgttgatagcacaaacaaattggaagcagcagctggttgtcgttttagttgcttcttcaacatgcacattcttattgcgatgtgccaatatgtatatgcctgctcaacgtgcttgactgatttttcatgaatggtgtgctgtttctcargtctgatgtttacttgcctttctgtcaacactgaaacatacatgtttcttcaatctgtctaccatgtaaaatatgggggcgaattgatatttctttcatttgaagaatttgtgcatgcacttaaccaactattatatcatctgaactctattgcgaact

SEQ ID NO: 12344 - DNA, 487 bp, Zea mays
caaatatatatttatatgatatataaaaaccgtagtataatagggtacctggctagtttaaggtataaataatgcaagctgacgtggttcatatccatccaatgttcaccctttgacgagataacagttgtacaaacggatttgaaagaaaacacaatcatcaccagcgacgttatctgaaaacgacatcacatggatttttctcccgtcatcctctgtccgcatggtaaaaccgccactccctaggcgacgcgtcgtgctcatgcaacgcgacgggatacgatttgaaccctgtccttttataacggactttaaatatattctatattatactgggtaggaaatggacttcaattattttcctacatattgtttactagatttttctatagattcgaaccgtaatccattaccacgcctcctcacaggcacacctcacacgagcagcagcggacgataagagatgtgctgaagctgaacggtggcc

SEQ ID NO: 12345 - DNA, 1063 bp, Zea mays
tgaaaaatccactcaaacctaaaaaattcaagacatgactagcttttgtcaaatatcatggttataacgttatatctaaacaatacttttaaacaatactgtggtattctagataccatgttgttttaatagattgaaaaatccacttaaacccaaaaatttcaaaacatgactaacttttgtcgaataccatggctataccatagctataacgttatatctaaacaataggtaatatttttgaagatggctaaaattatattactattatgacaattacaaagtatagtattaaaaacatgttttaaaatattgttactgaacatgccctttaccgttggtatggttactccacgacaaaggaagagactggaaactgaattctgcccagttcagtaatcagtaatcaccagtgatatgaacgtatcttgattagtttaaaaacattctgacatggaacgttttggtctagattctagcttagcttaaacaaacaaggtgctaatatagtcgcctgcatttgcggctacgtttctttctcaaaaataccactctgttgtcttggagacgttgttatgggtaccttgtttctcagtggtgaacggtgggcgtgcctgtttttttaaaaaataaagttcataaataaccagcaaaaaaactttagcagagcacgcaatgagaaagaaatcaagggttcaaaccgcaaccctgattttttttcaggaaacagttaaataaactaatcaccgcaattcaagaacgccacaccatggcgatcgaaagctaaataaactaatcatcgaataaaaacggactcctcagcaccgcacccatacataggtgccggactcgtcccagcgaagaaccggacgagcgagcaagaggcctcctcctcaagcttcgaatcctccccttccgcgctttccctccccctcctcctcctcccctttccagtccccaccccagcgaagcttccaaagccgccccaaccccaacggccgcccggcccgatcgagcagacagctgccgcggccctccccgccccgcacgcgacctcggagcc

SEQ ID NO: 12346 - DNA, 809 bp, Zea mays
tgcagcgtggcatttctcttgttaacggctcatatgccgttccaaattaggagaatacatatttttatcttttccacgtatattacttttgccatatatatatatatgccgtacacgatgatacatgtagtgctgggaaagtttcaaggtaggaaggaattattgtgcctggactcagcacgtatgggtccacacagctagctgagagaagagacgcagctcagtttcctgcctaatcacgggccattgccctgacaacgcacgacgtgtcagcacgcgtgccggttacctgttgcttgtgcctaatcacgggcgccgcatcgaaaaattagctttaggttagtgagctaactaactagtgcatgccgacgcgaattccaggtgcacatatcactggtagggccagacaaggtacgggtgtcatggatcaccgcggccgacgcgccggcgactgtcgactacggcacggacccaggcaaggccagtacccattctccgcgaccgggaacacgacagcctactcctacgtgctctaccagtctggcagcatccacgacgccgtcatcgggccgctgcagcttccagtcgtcgtcgccgccgcgccggatgcgggcttgtacgggctgcccggggtcggcgtccgggggctcatgggcaccgcgacgtgcgggctgagcggcggcgtggacttgactgctgggagaggccgcgggctcagcacctgctccgcgtacgccttgcggtgcttcttcgtctccagcgaacgcagcacctgctgaagctccttgatgtagtccaccaccccgcct

SEQ ID NO: 12347 - DNA, 569 bp, Zea mays
ccttacggaagcaaggagacgtcagcaaggattcgacagccccgacagctgtccttccgcagggctccagctctcctccgacggccacgacatcacatgaacagggtgccaaaacctctccgactgccatgacgacatgtacttagggctctagctcctctctgctagacacgttagcacactgctacaccccccattgtacacctggaccctctccttacgcctataaaaggaaggtccagggctctcgtacgagaaggttggccgcgcgggagaacgggccgacgcataaggctctcgctctctttctctcccacgcgaacgcttgtaaccccctactgtaagcacacccgacctgggcgcagggcaacacgaaggccgcgggtttccccttttgcctgtttcttcccccccttcgtgctccgtctcgcgccgacccatctgggctgggacacgcggcgacaatttactcgtcggtccagggaccccccggggtcgaaacgccgacagttggcgcgccaggtaggggcctgctgcgtgttgacgaacagcttcccgtcaagctccag

SEQ ID NO: 12348 - DNA, 330 bp, Zea mays
aaaagctaggctttagctaatgcatgcggaggatctggccaagcgcgtccacataaccaaacacgcagaaagagattttgagtctaaatcgtagatcgtcgaatccctcctcaacgcattcgtttcgacgaatcataatgtgtgttttataatgacaaaaatctcgcgagtcgtaggctcgtggtcgtgggtcgtggccctagcgacaggcacaacaggcccctccgctcctggcctcctcctcggcgtcgcgtcaacgttgcgcctctccagagtcgccggccgccgagggcactctccacctcttccgtcggcgcccgggagaaggag

SEQ ID NO: 12349 - DNA, 158 bp, Zea mays
ggtaccaaactttgggttgaaaataataaagctgagaccgggcgggtgacttgcacgagaagggagtctcggtgtagtgtctccgtctgagtcgattaaggaccatgtcgatgtaggcatgatgattgaggaccttttaactggtcacatgccttgtc

SEQ ID NO: 12350 - DNA, 1500 bp, Zea mays
cggtgttacaccggacagtctggtgaattttagcggagcggattcccgaagctggcgggttcagagtttctctcccttggggcaccggacactgtccggtggtacacgggacaatctggtgaattatagcagagcgcctctgagaattcccgaaggtgtgaagttcagcctggagtcccctggtgcaccggacactgtccggtggcacactggacagtccggtgcgccagaccagggcacacttcggttgtcccttgctctctttgtttgaacccattcttggtctttctattgacttattgtgaacctttggcacctgtagaacttatagactagagcaaactagttagtccaattatttgtgttgggcaattcaaccaccaaaatcaattaggaaatagatgtaagcctaattccctttcagttttatttccttcataaacataggatccctccaacagccatgcagctaaatgcattagaactagtttatgatgtatactgaaacgaattttactacacgatgtaggtatttatgcaattccttacactgcgtaaaaaaatatggcatgttgttcactggtggacgcatatccgggtagagcgtaaaaaccttaagttttgagcataaaatccctcaattataagcgtaaataccgagtcaatgagaggttgatagctctagtaggttgttattacgatcctatttttatgacagatccgaaaaacatggcagccgcatgcatgcggtttctatttttatctagatccaaaaattatggcaaaatcgtgggagtttctattgcatgcgcgcaaattacgatcagcataaattaaggaattgctgtcggcgtctcgagaccggggggtccctaaggccgacgagtgagtgtgccgcgtgccccagcccagatgggtcgagcgcgtgggcgagcgcgaaggggggaagcgaggtggccggagacgggcgtgagagaggtggaaatcccgcggccttcgtgttcgtcccgcgctcaggtcgggtgcgcttgcagtagggggttacaagcgtccacgcgggtgagggaagcgagcggccccaagagagcgcttgtcccgtcctcgtccccgcgcggccaaccttctctaagaaggccctggtccttccttttataggcgtaaggagaggatccaggtgtacaatgagggagtagcagagtgctacgtgtctagcggggggagagctagcgccctaagtacatgccaatgtggcagccggagagatcttggcaccctgctggtgtgaagtcgtggctgtcggaggagcaacggagcctggcggagggacagctgtcggagcgattgagtccttgctgacgtccccctgcttccgtaagggagctgagagccgccgtcgtcacagggctagcggggcgccatcattgcctatctggcagagctagccagatgggacaccggtcttgttctctgcggcccaagtcggctcggggtagggtgatg

SEQ ID NO: 12351 - DNA, 887 bp, Zea mays
ggtgcgtgcgcttgttgctcctaagagagataggattttgctttcgaaattcccaccgccgccgccctgccctccttctgactccgcttcccaaacttcccaaacctaatcgtttcgtcgtgtaggtggtggtggtggagatcgattgctgctgctcatttttcaattaatcattagggtcacatgaggattggatttatcggggggacttgtgatttctgtgatccatactccatccgttcgtttctggatttcgatttcatcgcagaaatccagcaatacccccatggcacaccacatgagccgagcagccccaatccatccgcgaagctgcctgggccaggcagctccccaggccgttggttttgagcgcctgctcgccggatcgacctgcctgcccgagcactcttcccccactcccaggccacatcgccaaccaaacaggccctacggttgcgaattggcgatgcgatctccaacttccaatgctgccctcctagtcggttccaagtccacttgcagtcaccagttccgatcaggctctaatctgtctcgtcaactcggcttcaaccccccttcctttgctttcccaaaattaactactgctgctccataggttcacgttcaactctacctacttcaaattcaaaattactagtaccattcttgtgctgcaacttgcacttcaaacatttaaaatgggagtgggagtggaaatcaacccatccgacaccgacccgttccgtgtagcagtaactgcaggccaacatgcaggatcgactgatttccttgtcactggagtgcccaaaagctgccacgcttcagcatgcacttgctcatgtgcattttttcttctgtcctacttgcaggataaggattcatgcgaa

SEQ ID NO: 12352 - DNA, 282 bp, Zea mays
gtactttcactagctatagaagccacgagatggagtggagcccatataccagggactctccctgttacacgtgtaccgttacagtgaccccgggcccagttgtcagcgtcagcagagtttataatgcaggctgcagcaggggcagggctaacccaagcaatatttagatactagaattttcagttcgaatgcgtaaaacagtcggttctctgccaaatcaatcaaatatgaaaaaactatatatttgcaagatcctgaaaggaataatcaggggaagatacg

SEQ ID NO: 12353 - DNA, 624 bp, Zea mays
cagagattaggagagatcacacgtcaaatagtggccgacaagccagtagccattcagttacgccctcgtcgccgtcgccgaccactcctcccgccgcgtcaccgagaatataactttgttggcccacccaactcaagcaaattgacctggacggacgaactgatgaagagagtcgatgtgggcggtgaggaatcaggttcctccacctcttccctcccccacggcaaatgcaaatgcaatgctgcctctgcgtatatataccttgtttattatagttatcctgattcacgccggaaaaaatgtattttttttcagttcaaaattggaagacaggaaaatatgggaaggaaatatgcgccgccgccaacttccctttcggtgctcgccgtccggctccggccagggatggatgctgaggtcagcgagatggtcacttgtcacccagagagcagagcgccatcttctccgcgcggccgggtataaatcccctccgcttctcctccaactcctctccacccgctcgactccaagcgcaatggctcatccttgcttaattaccaaggtacctttgcaggtaggtaggtagctagccgccatagcaagctaggccgaagcagaggagtg

SEQ ID NO: 12354 - DNA, 721 bp, Zea mays
attggtttctatcggccaaatatttcgcttctcgtttgtctacgtgagaattatctaaatcaacgtgaatgcatgattcgtcgactcgttgcgacataaattcactggacctttttattattttatgatatttagattctggtaacagctagatcagaaacttttaataaatgatggcaacttttaagaaatgatggcacgtcgatgagctgaaaaacaacgggcgaacggcagcgacatcgacctgcagccgtaaaataccacggccaaccgaggttccaagagacaaggccagacaaagacagtgggttctttcatctgtgcaggtacacccagaaaaacttcgtaattaaactacagtgcaaagaagccatacggcacagaccctagccacacaaatacgccagttgtcgggtgccccactgcaaaaccacaaaaacttccggtcttcacgcccgcgccacgccgcctggaccagagtcaccaaaccgcggacacgccacgaaagcacgaaccagggactcgcccgccattcgccaacccccacgaacccacggccctctccgacccgatcgccatcaccccacgcactcgcacccttcagggctaccccataaaaacgcccacgacggcgactggcctttcgattcgcccagggcaatattccccccggaccaaactagatcagcgaaacccactccgctctcccgagatcggacac

SEQ ID NO: 12355 - DNA, 171 bp, Zea mays
cctgcagttcactacttagttgttagttgtaaggaaggagatcgaagaatcctctccatatgcatgcatgcacaaaaaaaaatgatttcgttccatgatccctccccctctctataaatgtcaattccggccgcattctcacgtaccgatcgacaaacaacaaaagcagca

SEQ ID NO: 12356 - DNA, 277 bp, Zea mays
ggtctacactaatgccttaatagttagtagagatttacagagtatgatgtacttgagggaaagcattggatcagcattaaatggccctcgattgtatttgcttggataacctttctattcacatctgattcttatctgctcattgcaacgrtcttggactcttggggattattttatagttttatgaatattaaagtcatagataaaagtagcgtcaaatgtagagttacggagaaatgttgtgtttgtgattcagctatgtttttaaatactaaac

SEQ ID NO: 12357 - DNA, 1310 bp, Zea mays
gggaggcgaggctgggggcacaaggtcgtaggggaggggaggaatgattcaaataatattgtccattagagttgagtaagaaaaactggattattcagcaatcttactcattggttctgatgatgtggtaaatctggatgcaatttgtttggtggatttaatggaggttatggatgtgggtgatttggttaggtggtttttttttgcaaaagtttaaactggtgaattatatagtggtatagattatcaattatctgagtcttgaaattaagaatctgtttggttcgtggctaaatgtgtcacactttggctaaggttagtcgtccgaattgaataactaaccttagacagaaaagttagataaaatgtggcaagttagtcagtgaaccaaacataccctaaatatctatgaaaactatagaatataacttgtcattaaacatccatgtttatttcatttgctagtattggaagcaatgtcaaataactctcgagtgggattgaccatactgccatcgtttgttttttcaatgacctgaacagttagctttgtggggaaatacatccacgttgaatgaacaataaacagacgcaaattccagtaaccacacagcctgaaattgttgacccgttcagcccttgagctggacaagctaagatataaaccgaacatgatttaagtcttcactggagtaagttgctacatttaaatcgactactttatcatttagttagcatcttgtcagctctagtttgcacccgtgatgattgaccagtttttctaaacaaaacaaaaggccaataaaatagagtcgataactcagaacagacgttttgacgcctaataaaaaacttgtttaaaataatcagaaggcatctgggccgtccacgctaccgacgtccctgatcatcacatcatcctcgttgactttttaaaaatttattccgatcgtgctccacctctcgctcgcaaatggaatatcatatactcacgagaattgcttcctgctcaagtgaaggagccaatgagactgcccacctcacatatgcatatgctcccacctccctgtataagatcacagaaagatctggcaaagactctttccaacgccaccacgccattgctgcaattctcgcaacctttctacctctccactcaatcatagcatagcacctggaacaatttcatgtgcaaatctagattgattagtggttgcaatctcgttgggtgattcgatcgaggctaccagtgtgctactactagcacttggatttgccggtgcaagtttttctctctctttttgaaagcc

SEQ ID NO: 12358 - DNA, 1500 bp, Zea mays
ggagagaaagaggagagacagcacacagcagcgcggcatccgcgtgcgtgcgtgcgtgcggacgggggagaacgctgggaaaaaaaaaaccccgtgatctcgtggacgcttcgcccgctttggctttgggcgcggcaggtgcgtgcggacacgtacggagcggcgtacggccccgcccgcccgtgctcgcgtcggcggttccgcttgcccccacctaaacacggaaccggcgccgaggacttgggcgccgcggcctacgggcaccgccgcttaaaatggggtggtggagcgccaccagcgtggtacacgccggcaggagttggccaccagcaggaggagagagacgtcccgagcccaagggtccgatttgaggccggggtctctcggccacgggcgagattacctgtcaggcaactacaaaagcgttgcaaacaaagagcgcgtaataagcccccggcggggctggaatttgcgccttctttttggacttgctgttcgcccgcgttgaatgcaagggcaagcaaacgactcttccgtgtgctgtgtgttctggggcctggtaagctgtgttccagctccagctactaacattcttggcttctatttgaagcaagtccctttccgccgtaaagaaaagggacggggcaaaggtagataaacacttcttcttttaaaaccccgctgcactgcactgcactgcacactttgagagcaatttctggggcaatttgcaaaaaaaaagggcgtcaagaacaatcagtgctcgaggctactccagccttacaggtgtctcagtgtctggcgattatgactgatgatctacggcgcgtgytgatttcaccgtttgacgtaactagtagttggtgccagtaacgcagacagtgacccacgtagtatggctcggagaaagaaaaaaaaattgcctaggaaagtgacagcctctcggatcgtcatcatcacaggctccccctcagccgccgggcgcgtctcaagttggctactacgtcgataatggtagtaggttccagcgctattgcctcccgtgcaaatgcaactcactggcagccccgtgtgactaaattccaaggccttgcatcgcacgctgagtgcccactctgcatcactgtgaatgctgaaccccagacgcaggaattcagaacgctaattaagtcattataaataaacgtcctaacaaagactcgattttttccatgatgcaacaaccaaagtagcgcgacgagattttttttgctgtgatgacagcgccttttgtttatttctcggccaacgagaaagggcttggcacggggggcttcaggttcaggcaccaccgttgtttgcctataaaacgacctaccaactgcgcgtccttctgagaccccagagcgaagaagccccggcctcctgtagagctggtctccctctgaccctctctcctctgcgcttccgctgcgtcggccggccctgctcgtagcttggaggcggcggcattctccggca

SEQ ID NO: 12359 - DNA, 359 bp, Zea mays
ggggtgtgaagggaaagcccccattggtagaaaaaaacccacaaaccccttgggggttatcctgcgcttggaagaagaactaggaaaaggaaaaaatatagtgatagttttattcttcgtcgccgtaaggtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacatagg

SEQ ID NO: 12360 - DNA, 143 bp, Zea mays
ccggaagcaacaactgcacgagagagaaagagcggatccaactaaggaaatgcagtacctgttctgtcggagctaatcatgcaaagctagcgtagcgccagccgtcgaagtgaatgaattcgaaagaacgaagaaataaggaa

SEQ ID NO: 12361 - DNA, 657 bp, Zea mays
gacacacttttgatttgttagagagagatttgagcgcgttttttagttgtgactctgtcgttttgattcatgcactctcttgtttgcttgtgtgcgtggtgttgctgcaattgtgctcttgtgtgtgtttctactccccttcttactctgatttgattttgatcaattgtgtaaggcgtgagagattacaatttgtggagattcctcacaactaggatattgatataaggaagacaaccgtagtactcaagtttgatctttggatcacttgagatgggattagtgcaaccctcatccattgggatgccacaacgtggagtaggaaaacatattacgcttgaccgaaccaagggtaaaagttactgtgtctcttgtgctatttacattattgcaatttttatcttttcttcattccaattcttcacttgcaatattgctctaggtctaaattaaatcttgatagaacaatcaagtgaaatgaacttctttcttaactctactctcaaactagattttaattctctctaactcacattttagaccaagtttgtgtggtttgagttaagttttgcaagatcacttattcaccctccctctaggtgctttcaattggtatcagagtcgttctcttcatcaagggactaattgcttgaagag

SEQ ID NO: 12362 - DNA, 419 bp, Zea mays
tctcgctagcatgctggacgacactttggaagcgatcacgtacgtccttgaacagattcgattgcagcagccattgtgctggcatgctgaatggcattctgaaactgaacatgtacatccttgaacttgtccagagatgggcaatttgattcggtcctattccttttcccgtcataattgtctttcttctgactcttagagcttaacgttgcggccggggagcgaccagatattcctgtggacatcctgtcctcttccacttcgtcatctccaacttcatttatattttcattctccatgttagcaattgcagcttcagacccttccaacccttccccagcagagctgtccttgccatatattgcatcaaatgtatcgaaatatacaaatgggacaccatacagacccttggctctagg

SEQ ID NO: 12363 - DNA, 346 bp, Zea mays
tatactaaatagtaggaatacgttacatggattaagcaaagatacccatcattaaacaaagaaaaaaagaagtgaaaaggagacgtgcggattggttgaagagctgcatgcagatgggatagagatttatccggttggagaagatcacgcttattttgttgagagaaagatgggacttatctaacctttaagcatatccttttattgattataaaaaggccatgtgcagcagtcgtcaggggaattccagagtccatagacccatgctgctacaattactaaccgcgtctcctctctagtgctcgctaccgccctcttcctggtcccgtcgtccgtcgaggtcatc

SEQ ID NO: 12364 - DNA, 506 bp, Zea mays
atattattttaaaatttagatactgcaaaaatacttttgcatgtgtacaaaagagaaaaaagcaaggaaataagtttctcgcacaacaaacgaaacaagacaatccacgatacatgccaaaaatacaacaaaaaaccgaacagaaataaaaaacaaaaatcaatgtgagaacaatgaatattttttagaaaatatattgtataatttatatttattggtacagtcgtgcaactaaaaataaagttggagagatctttctaaaaatatatttttaaaataaccttcacatcttctttaaatatttttcaaaattgttattttacttgcttctcatttttacagtgaaagccctggtcccgtcctcttcagggcctcgccgtcgcctcctctttttttccccctcctcgacggctcctcctcacaggctcacagcctcacactcacgcggagagcgctcgcgcgggcgcacacgcggaggggacgttcacaggagggggagggaggag

SEQ ID NO: 12365 - DNA, 289 bp, Zea mays
ggttagtcaagattcattgatgatccacctatgttaatgctgatgtgcaggaagtatgcttatttttttacatcttttttttctctgttgctcatattgctgcactttgctgctgaatctatccctcttcccatgttttattagtgacgtttacttgactgtgatttgtgaagcttgatttaatcacacaagatgctttcagagtcttatttcatgcagttgtttcccaatttgtcaggttcacctgtagttaattttgtaaattattgttatatctgtagctgcccca

SEQ ID NO: 12366 - DNA, 1484 bp, Zea mays
atttgtctttataggacaaaataaaagtcaccgtacaaaaattcattcgggttgaacatgtctagtaggataagtatttaatttggtatgggtaagaatgtgcatatgagcatctccaaaagactagctaaatgatccgtctaagctaaattttagctattcaacagcaaaataactcttcaatagattaaacatctaactcgctaagctatctgactctctttattagctccctcactatataaatttggctaaccactttaactagctaaactagttagatattttgttagagtgatggtacatatagaaagtaatttttataaaaaattaaatagacagtaaaatatagagttaaaaataaagggttcattgcaaatgccctaaacatacaggtgtttgtgtttatacgatgattcgggaaaaaatggctgctctgatgactgatggagcagtgcaaaaagatcatcgaacagaaggggctgaaaacctcaatcagctataaataaataaataaagctatcatatcacacaaacagatcgcagcggttcgcgtccaatgggctccttgttctatcctggaattaaaaaaccggaaacgattaaaaactgtttagttttttgccagtattcgatctaacccagactaccaagcatccgttgtccccttgtgggcttgcgtcccctccccaattttaatgattggttgatctctcaattccatgagccaaacagccatcccctgctcgtgcttgggagttgggaccatcatcctccttaaaaaaattctggatcagaaaacgaaacacaagcaaattgcatttcaagtcttttgggtttatacagcacagataaaggcggcagcggcagcagcagaccaccctaccttttcccctctccacctcccgcaagcaaactcacggcaccgcccccgcacccactgtcctctagcttcttcctccccgctttcatggcaggaaaggctgaggcgatgatgcccataggccatccagtttgatccatgccatcctggacctctatacatactgcctcagcccgggcactcgcgatctctacttctctaccgccgctgtgcctgtgctagctcctctctctgcttctgcttttgcctcactcagcctgctgcaagcttttgctttggtttaggtgcttcttttgcattcctttactgttccccccccactttcgctcgctttgccacgcacacgaaaagctcctgcctttaccttctcggaccttatctccgccccgtagtgggatttggtgggagctgcgctgcagctgcttgccccctcgcgtttctttgctcaattgggggggtcacagcccgcgggtgtcgcgcgtgctcgtgggcggaattcggtgttcttgcttgcgcggtcctcgtccccgtccccttggcgcgattgcggttgcggacgctcgctgcagatcttagcgcgactccgggagcgccgccggag

SEQ ID NO: 12367 - DNA, 344 bp, Zea mays
ggtacgagttgagttgcgttgcagggcccggcggcgacgacgtccagcctatctcgcacgtctctggcgctggcggtgggggcacgagtcatcacggccagtggcgagctgcgcacaggcacagcgcaccaaaggaagggccgacgccaagtggtggcgatccagtcctccgccacgccgcggccccccgcccccccgcgcgcctctatttataccgtggccgccccctggcacacctgcgtacgtgagcgctagctcttcccaccagtgagatcgatcgagcttccacctcctgtcatcctcctcttgcaggtcgcagctgagcagcaacaaggccggaaagg

SEQ ID NO: 12368 - DNA, 1018 bp, Zea mays
tcttgtctctgcgcgagggtcttggaccagttcggtgatgaagctcagttggaatggagaagactgaagagctgtggtctctactgcttgaagctgaaccatttgactcagatgaatatatacatctttgctctggaacactaccctggccccaagccccatccagtgatcggtgtgctcatgtctgcagcagaggggttgcctgaagtaccaatgcgaagacgtggcaatagtttatgttctctatgccggcctttgcagaggtgtgtctacccacaatatgggccttgtttaggccattgccccccttgattaggtgccaatgcatgcttgaaagtaccaaagagaattataatcttggcaagtactctgcctggtctcaggtgtgacatacatctgcccctagaaacttgtgcgcttgtctgcagaggaatgtacacgagcgcgcatattttttccccccagtgcattcctcgagtaaagtacagctgtacaggcgaacttgtcagttcggttgtttcactggcatgtcgaaaaggcattgttttgacctcgttgcaaaccgacgacaccggtcaggcgacaacggccggtgtttccgcaaccgaaccattctgttgcttacattgttctcaaccgtgtccagcttcatagtttttgtatcatgggagaaagaccacccgagtgaacagtcgtgcgagaacaggaaatttgacccagtcctgacacatttcagtcaatgaattgttttgttttgttacataacggaaggcaaacattacacagtgagctgggaactcacagcttctttgccagatatactttcatctgcttaaaatctctcacaggacagagctcaaatctgttggttcagtcaccaacaagaatagtatcaggtttgttggttcaatcaccaacaagaataatatcaggtttgttggttcaatcaccaacaagaatcgtaacacgtgtcgcagtcgcagcaacgggtaacagctaacgacaatgaggagccgag

SEQ ID NO: 12369 - DNA, 647 bp, Zea mays
atttatagcacacatgttgttgggtctatgcttcgtcgccgaaggtcttatagaaagaagtggtcctcgaatgaagctgtttgtataagatagccgaaggttcctcttcgtaaagcttcggcattacaaaccgacttaaagatagaatgaccttttagtccataaaggtctgagtcaatgttgtaagtttttataaggggcatacttgtaattcctcacaggctgcgccctgtgcctataaatagtgaacagtattccgttattgttcaggcattcgattaattacaatcgcatctctcggaatccaactctttgccaaggcaaaggtattgttgtattcaatagttcaatacattaagtaaatacaatgtaattcatctatgatgtatttattcctttcatacctttcgttttatgtcatttcataatttttactgaaattttattacgaagatttgagcttcgtaattatgcttttatcaaccttcgtccaagatccattgttctcgagagaataatgtttcatggacgaagggcattaacatttaacattttatgttgccttgttcttaatcttaagcatttgagaacaagtccccaacattggcgcccacctccggtgaactcacttccacttttttgagttg

SEQ ID NO: 12370 - DNA, 305 bp, Zea mays
cccctgaagaacccgattataagaaagctggtactaaatctatctgaactgttattattctataatgatgtgttccagttatattgaacttctgcaaacttgcttgctgatttgtatgcagttgattggaccatgcatcggaacggaccagatctattatttccaggaagaaaagggacaaaattgaatttcctgtggagaatcatacacaaaatagtctggatgcaagcggtcacattagcagtctacctacagaggatgtggaccatagattaggtgctggaagtaacattaatttaaacaat

SEQ ID NO: 12371 - DNA, 105 bp, Zea mays
ggtaagcatatacgcaaaagcatatgttccacacgctttaataacgcggttttgttggctggaattctaacgatccctcccatgtaatctgcaggcgtcagctcg

SEQ ID NO: 12372 - DNA, 1366 bp, Zea mays
cgaccgtttcatgcgtatgtgcaggtacagtcaaataagcctatgctacattagttcttgcacggtcagcctcttagatgcatcgaatcaaacacgctactttagatcatggtcaatgcatataagtcttggctctcattgtgcggacaactaaacgcttggctagtgactccgtaggacattcggcacgcataaaagctgttgtatcataaagctggaagcttttcgtacacggcgctctacaatgatttaccacgccagcccttttcaccgtcagaggggtcttccgggccggctcgggcggcatcggcggcaccacactaagcctagacgcaggcgcagggcagctcggcgcgccacaaggtcagcctgagatgcggtgaggacaggctctgatttcttttgtttgcttggagcggggagccgtggactgtgtttgccttttttttttcttttctgtttgataggtactccaggataaaacaatctttcagctggttgttgcacccggagggatagggtcatggctatttctctgtttggtagtagaagggtcaagtctcgtcaagaggggtgtgtctcctctgtcccgtgcgtgccgctaccggacgccaacgaaccaatccacgtctccacaccgcaatgggagggagggaggtccatgattaacccacccggtgcttgcactttccgccaatgaccgccgagccgtctccggcctccgcgctccgcggctaggcaggcattggcgcgacgggcgcaagcgcaatcaatgccaccggctcccctcctgttctcttcccgtcgcccgcatccgcagtcccagtcccagtacccgctgctttattcccctgcgccatacatactgccgtttgacctcgagctcctggctgcgcccctgctggcccgtgctctctaccccttttcccttccccgccattaacctgacgcgcaccaggcgcaggccgccgcagactcgccgtcgagaggacgagggaaaaagtcattcccttgcctgcttctgctcgcccgaaaaggctcccgttctgcaggcccgccccgccccgattcaatgcagccattgccttgttgagctcgtctcgtcccgctgctttccctctcgtcgtgctcctccccacgcggccacgccacgcctcgctgtaaaccgaccctgttgaggcttggacgcacccgcgtgtccgcgcctgcctcccatcccacgccccctcccctccactccactccactcccgcgccgtcaccggccggggggaaagctccaaccgaggggtttttgtttgtacgcgcccgtttggcccttgctgtggtcacatcgcccgctcccccgctgcagcagcgccaaagat

SEQ ID NO: 12373 - DNA, 1500 bp, Zea mays
ttttcttttcttgtaacctatcacatgcaaacggacgagttcactttagttttaacttgttggaaatgaaaatacaatgttttttcattcataaaaaaagcaaaatagaaaagggaaatgttttttatattttttatttatctggccagcctccccaaaaaatctcgtgtctataactgtgtcgtgtcaaacacagtaagttaaaatattttatttctgttaaagctgcagacgtgcagttattctaccctgcacagaattatgaaaatactactattactactaaacattttagaatttccacatatgtttatttcttagctgacaatgctggtctctgtgactttgtttttgcgggtgatagaaaacaagagaagaaaatataaattggtgaaataatggtaaaatataagttcttcatttagagcaactctaagagattaactaaaaaggctagtcaaatttactgatgtaactactctctaaaatcgattttacagaaaaagtatagattaatccaacagcctgaataaacctatagattaaatagagagtttagcagactatccaaaaatagagagtaaatgtagagagatagagaaacactaaatttaaagagacgtttatatagtttattagatatttcttcttttattattaactaaatttatctttacaaaactatgggcctgtttgagagagctttgcttcaaaagcttcagctttggttttccagttttactataaaacaactccatcaaattattaatgtgagttctaggagcgtttggtttgtatatggactccaatttatatagtacaattgatttgtgcggatttccttaattatccttgatgattagtgtgttgtcaccagagagaacggaagttgtatgttgcgtaaccagtggcatggtgggtaattttcgtacagcttcatgaggagatataaaaacagtgtttttgaaacaccctctaaggagcttcatcaatttcatgaaacgggcctctagtttcgattttttttaaaaactaaagctcgtggagctggacctgtttgggttgaagaagttcgaacaaaattgaaattcttgaagtgaagctcttccaaacagggcctaagtattagttctaatacattcaaacactctttaagttgggttcgccggtgtcggcgagactcgcgccacaacctcctagtttctcggctccgttagtgtaacaaatatacgtgatatgcacgtacggtggttatcgccgcgatttgttaacaaatataattccaatatataaataacaaaaggaaacaaaaatataggatgtcgttgaggcttggccccaccgcgccccgacatataaaaagctgcctgcctgcctgggtcgggcctcgcttaagttcctactaccacatctcaccgggccgcgccggagctgctcccttccgtttcgtccctctccttccggcggcagctgcgtcggccgcggctgccaacggccggt

SEQ ID NO: 12374 - DNA, 768 bp, Zea mays
tggcaccctgatcgaacctgatacagacgacgaggatacggctactggtgatgtcgacgagcgaggttgcatacaacagtttttttagcctttgtttgaaggaaccggcctgcgtgcgtgtgataagcttcaggcgagcagaacagccatagcgctgaacaaggtctctgtgtggttccaagccatttctgcagtcacagaacagcctttttttttgtggtggtggtgaggtgaggtatgatcatggaaaattgtaatacgctgctgctgctaacgacagctagcattggagtatcgttgaatgcctgctggagatctatataatactagcaagtagcaaccagactatcagtatcacgctgcatgtgccagtcagagaaatataatactactagcaaacgatgtcgatatgacagtgatcggctagtagagaaagaaacaagaaaggggccagaccacaagtgatggggcagagtttgaacatcccagaagcaaacgattcggcaggagattagtcatgggcgccaaacgatcggcatggaatgatgccccagtcacgatcgatcacggcatgaacgcgcatccgatggccgttttgcgactaaacaatagggggcagtggttggacttggaggagaggaacacgtacaaatatgggcaggcactagctagctaggctgcaaagagccaaagactgccggcaccgctgctagcttgctagcatacttcccctacacgcgcgcgcaaccgcaagcagtcgatcgtcgc

SEQ ID NO: 12375 - DNA, 1500 bp, Zea mays
gtacgagcgtctagcgtctggctagctgtagcctgactaatcggatacgcgcttggatcacgtctgtgtggatgcaagaaaagatgtataatttggctatgattacaccagcacatccggaacctgtttgttccatacagacaagcaaacataggatgaggtctggtcaatgcatgtgaagagcctaattgatctaacgcaggtaaccaaacatatggtatatgagcgtaatggatcacaacaagcgtgaaaagcaaaattacaaaaaccgcattatagaatttggtgggtgggggggtacaactcatagttgaatacttgaatatatttgtttacccgaacaaattgcatatcaatctgtagtcattaccgccgccaactaaaacccatgcaacttggaaccccaaaccaatcatgcagtttacacaattgagttagtcactgatgtgctgacatgcacctcaccttatgcactacaagcagacaagctgaggaacttatgtgcctgaatactaatgcacacaaaaacaaatctgacaatagtaccacaccttttaaatttctgaatcgtcccaattatgtttaaatgcagtggaagcttaaattactagacattgtgccacaagcatacccacaaagattaaacatatacaatatacaaatgtaaagtatatacatctacatattattacagaatttctagcatcattcaatcatctatttaagagcatcatagataattggataaagtagcagcactaagataataccacgtaacacattacatattccataacatgatcattaaatagttgttaagccttcagctgccttctatgacattatcattcaaaatgttgttaattagtcaaaagagatgaatgacgggaggtcaagttcatgctttgggctatgtttatagcaggtattttatacccacgggttaatgggtatgagtgagggttaatgggcatgggtgaggacgggacgccgtttagccattgagtgaaggtttttgaacatttagtctatatacatatcataacagctagtttaaaaactttattttctcgagtgatctctatttttttaagataaaatgtaataatttttctttagaaaaagagaatcctaaggaataatggagtctctaaaatagccataatagagtaaaattcatcggatatggggtcgcaggtgttgccatctctgctcccgtcgctagctggttcgagaatcacccatggccccagctttccggtaagctccacgtcagtcccgcttgtcgtgttcctcagctcgcaacgataaatacgcacccggtctacttcgctgcgagccaagctcaccagagcagagaaactcgcacgcactcactctcttccccccctcctgcccactctccaaagcggcgcaagcatctagcaaagctgcgcagcgcagccagcaagcttggtctggagagacagatatagccagccagagagcagcagacgaggc

SEQ ID NO: 12376 - DNA, 1500 bp, Zea mays
ttgcgatgtactactactataatgcaacggaatttcagcagcagaagcagcattcggtacacagacgcactacgcctacgttgttgagtgaagacgacactactcaaaattgcagacaaaaaaacgagctgaagattagacattgtaagcatagaggaaacgccagatgtaagctaaggatctgaaactctgcacgtttatggcaatatagggcccatgttgcctcatcatttcctgaacggcgattgacgcaaatctagtaccatgctggaaggctggaaggatcaccatgtccaacccaaatcacaggaggatggctcaaggacccttttttttagtagagaagcatggtaaaagtagcatgggcaaaaacccaagaatgctgggccagctaggatgacctcccaccacaaccgtatgcagtggaaaagtaaggtacaaagaagatgaaaaaaaggatatatttgtattgataaagctagattgttttttttgtgaaactagaaataatttcgttgagggcagaaaaatatatttttatggaacaaactacatgtattttatttagatcgcacgagatgggctgctccatcgtttctgctgggcctatatgggctggcccatctcctgctgtctgctgccgaagtcgccaactaacatagatcgcaccatttcccgttcacctccccttccgttacatcccaccatttgctgttcaccttccctcccgtttgcctcctctcgctgtctcgtagcttctttcctccggcgacggctgggcgagcggccgccagtcggtcccttcgtcggcgacgagcatccacctggtatgccctctcctcccctttccttttcttatgttccttccccgctgtgcgacacccagcacctcaaaccctaacaatttgtatccggatctagatctgactcgttcacaatgcatatgcgttgtacacgctacccatctcctatgctccttcccttacatgcgtaatttcgatcytcctcgcagcgccggcgctccatcttccgctccctcccttactcgcgctcggcacacaggcgacggcggcggcgctcaggatcgggctatcaccgacggggtccggcttctccgcccgcctctcgccactcgtcctcgcctccggtcctccgcacaccggccggtgatcctgcgtgcgtgcctctctctctcctcccgcctctggtggatcgtcaacggcgcccggcctgagggcagcgggagccagcagccgctgctccgccaagagggtcgcgcgccgctttgggaacgcttatgctccaaagctaagcgttacccgtcctcttagcgctccagcgccctgaagcgtgcgcttagtgccgctttctagaaccctgtgtggcataaacaaccagctgaagtggaactgtttctgagcacccattttttgttttttcattgcagctctgtaggttttttgtactatactttttagtggttctggccttcttgacaca

SEQ ID NO: 12377 - DNA, 821 bp, Zea mays
ggtatgattattgctctgaattctttgaacttgcaactgaattctcgagttcagataatggtgaagatggtgctactttactgatgtataaacattatgttgcaactgctattcccaaaggaatccattgattgtctctgcgccttactgacaaacatacgagctcgaaggtgcagggaagaaatatttaccaaaaccgaaagaatttctttgggcactatgaacacaaaggtctttatacaatgattactcgactgccaaatgagcactatgaacacataccagaataagctaaattgtactgatgcacaagatacataaaaataccattgtcgttttagtagattattaaccatgtttgtgctctccacgtgtcattgatatattcttataatttcttcacttgtgtttttagttagttgttcatctatgcctagatttgctttggttctgttcttgtcatagctgaattcacgtgtattgaagtggactgtggtgtaacttaaaataatttacatctcaatccatctggattagagtaatctgcaaacaaaacattcagaatatttgatctaatgaacagccagttcagcctctcgccattccctttcccacgccgaggaatccgcaggcgcaggcacgcgcgagcggcgtgcacctccgcgcgatacggaactcataaatcttgcgtggccacccagccccagcggggtagtagctagcgcgccgtcagtgcgatccatcgtgaccgggtgctcgcgccttgtttaagcgacgaaccccacgcgccggcggcgtgaacgcacagtgataatacatgc

SEQ ID NO: 12378 - DNA, 69 bp, Zea mays
gtgatgctagacagtgcattacagtaaaaatggtcctgaggcctgagaaaattttgaggtcgttttgtg

SEQ ID NO: 12379 - DNA, 1500 bp, Zea mays
aaggtcagcacaacagacactacatagcaaattaaagtctagatgttgctcttttgaagataaagctatgcctttgtttgaagtttagatttaaacctcatcttcctctgtgcacattcatcttatgttgttgccttgttggggttattttccagaaacatgcacttttgatggcactcatggtgttacgtgaggactgtaaataatctctatagtgtgacgtagcctatcatgaactcatgataatgatgatcatctgggcaaacctttctttgttcctttattatatatatgctatgcaaacacaaccctgcaattcagagcatggtgcgtgatgaagctgggacatcaaatggtggtctgaagagtgacccaatgtgcaatgcctgggagatggctgcggtttggatgcaaaaccaactttcccagaacaagacatatataggaactcatcctaaactacattaatcaggtgagcttaactgacccagggcacagagattttctgtgccatttagcactctactttgcttaattgtttcactatgacagctttgtgagcgttgtccgagtcccatgggagaatcagccgtcgactctgccagtctgacattgtattcaccattggaggcaagaagtccaagctggaacccgagtaggtgtgatcccttctccattatcacactattggcccttggcccttgatctttattagcatgccatagggtctgcctaaaatcttgagttgccagatttgatcatgcttgtttatccaggttttgaataatattgagatgctgaccgatcagcagtttgggcctttctgtgttgaacttttagatgtgtccttctgtgtagtgttttcacatgcttagcactgaagaattcatttttgaacagaaatcatttatctttctgattttaaagctagaatattgtttttgtagaaggaacactctatttggcgagattttaatttttagttgggtctctgatttcaaatcccgattccatgtgcaaccaaacaatagaattctagaaagctgattacactttctaattccatgctccaatatctatatccaaatggggtattagatgaaatatactgttcaggccttgtttgaatggcacatgtatccacctcaatgactcaatcacaaatcattgaggtggatacatgtgcatccaagcaaggcctcagtggtgtatcctcaaccatcctttgttttagtatgcaatctggcagtcacacacaattgttatgtattgatgttgttgtggttgcaatatggcatactatcaaccctatatgaatatttaatgctgtataacttggcctcattttttagccaagtgtgcttaccttaagtagctatatgttattctttgattccccgtttatatgatacatcctcatgttttaactgtataacagaatggaagtggtctacacagaaggttaccatattgttaagttaaagttggatcattggaaca

SEQ ID NO: 12380 - DNA, 1016 bp, Zea mays
ttttaaggtattctaaacttaggtcttgaccttaattttcaaagctgtagtattttaaatggtggtattgtcttgactaaagtattgtatagtattttaaatactgtggtttgcaaaaactttgttcccaaacagagccttagttactaaaaataaaaaaactatataaaaagagcttaattttttgtccctgatttwtttttttatctcccgaggttaatttttcttactagagctaaataacactattagggctagtttggcaattctatttctcccatagattaccattttacaagggaaaataaactaattttctttgagaaaatgtaaataccttaaaaatggagtttccaaactattcgttataaaaatactcaaatactgtggattttgggaactccattttcccaaaggaaaatgaactaattttccttgagaaaatagtgtttccaaactaaccctaactagattaattttttcatatattttttagaaacacttagcaaacagtaatataatgatatttaatttttacaaatactttttcttagctaaattaacatatacatatattttgaaatatttatgtctgagctaaacagtaatataatgagaattttaaattagatctgtataaagtttgaaatatttatgtaaattatcagctataatataacggctagtacgacgactgtgatgatgcctgagctatttgtggtcgggatagatagcgttggatggatttgggcggggcgatctttgcctccacctggccgccggccattgggcgccccgacgcgcgatatccagaggcgcagcggcagccaatggcctgggcgcggacgtggcgcgccgggcgtccactagtcgcgccccgcaccgttgagcccttgagccgtcgtataaagatctccccgccgcaccaggccattcccaccagcaagaccaacaaacccacttctgactgaccactgtgccgcgccgtggtcaccggacggacacacagaacgacg

SEQ ID NO: 12381 - DNA, 503 bp, Zea mays
tctctacaatatatttgaggtaataatcttacttctattttttactgctcaagtctttctgtggtacatcaagtataattagttgatatatataatagtaaaaaaatagtttttatggtgttggggcctctgtttataatcttgtcccgggcccctcaaaagtcaggaacggccgtgcttttctcataaaaaacacaaagaaagttttaaaaattgtagacaaaaaaatgataaaccgaacgcccgataatacccttctaccaaataccaacgcattcactcatcagtcatcactcacctttgcacacctcgctgcttcgtcttccttcccgttcttttataaggccccggccccgggctgcgccgccgctcgcctctcctcccttcccttccccgtaccgtgtcactctcctccccggttcgtcgtgcggagggccaaagcttcgaggaagcagaaccctagcgctagcgctgttggagtagtagcctacgccctacggccg

SEQ ID NO: 12382 - DNA, 165 bp, Zea mays
ggtcggtgcagtggcgacgcgacgcggtgcaggcagacccgcagcggctaggaagacctctgcaaaaaatacatgtctgtcaacaaaaaattcacatcaccggcactcgatcaagcggttaatacaatacaaaatcaagcgctcgctctagttgatttgcccaag

SEQ ID NO: 12383 - DNA, 296 bp, Zea mays
agcgcttatatatttaattagctatcttgctcttgcttgccctagctgttgagctagcatgcacatcatatcgcctgatggatgctacatctatatatctatctatatatgtggttttgctactagttaatttccctttcttgcatgctgaagagaaattaattaagaaaaatctatatgtgctagctatttgaaactaattcgaaagattagacaaataaatctatcagatctgacggccgggccggggggaggagccatcatcgtcgtcgtgcatggagggcaattgaagggca

SEQ ID NO: 12384 - DNA, 469 bp, Zea mays
ctagacatattctctcccatatcgctccgctgcacataatctctctctgcccccattctgtgtatttatactcgtctgatcagtctctttctcatatgtctcttgccttttactgccgtaacctaaccatgacaaagttgacaacacaagaaaccaatcgaattctttcggctgccctaatatctcatctcctttgacatctcaagagaaagaggaacgaacaagagagagagaaagcactggctctgtagctagctagctacagcgatagcaactcacaaaaaaagcggcaccacacacccacacacaccagaaaacacaagcacaagcaaataagcagcaccgccagcccggccaccaagaactccaagaataaccttcactgccgtcttcgttcgatcccttacgctaacactagctgcttcaggctgcagccaccagccaaaggtagggcgcgcgcgcggcatcc

SEQ ID NO: 12385 - DNA, 1344 bp, Zea mays
gagggcaggggtggaggcgacggcgccgtgccggtagcggtaggagtacgtggcgcgcggcgcggccgcgcgggggcatcttggcttttgggaccggtgtcgaaaggaggctccaaccgagggcagtggaataaagcgtcggcaacaagtgcatgggttggattggatttgttttttcgacccttttgcatgcatgtggaccgtctgtttcttggcaaccagagttggatcagctctgccggcgaccgtcggctgggacctgggactgggagcaccagacaaccatcttgggaactccgctcggactaattacagccggcgcccggcggcaccgaactacgaactactagccgatgacaaacgccggtacacgtacacctcaaatggatgcgtgggagctcgccctacaaatctgcagattatataagacggcgtcggatgccgcgcaatactaccaactaataatcaagacatcacaggtgctccgcagtcactccgcttccacggttccacgtcacacacatacactactagctatggccggaagaaagtgcagagcgattcccacggcccaagcctcccggcgacgggcctccgcttcgctcgccaacttggccgccttcttcagaatttggatcacaaactcaacatataggatagcaccacctttccgaatccaatcctgaccgatgtttcttcgttgcacatcatttgtcgctgtcaataaatctgggtggttgtttccccacttgtgtagtagtgtgtagcatactacctgaaactactgttaatttctcatgtagtatgtgttgaagaatggtttggagctaacaatacagacaccaacttttggtaatgatcggaaccgactggagtgtagcaatgaatctctaattgcttgcaatataaccagatacctcattcacatggattttttttcatgttacagactagtagccaagaacaaagaggctagctagcggtgataaagttttcataggtacaacaataaaactgaaatttgtggtatgcaaataatacagttatctttcttcatatgtattgcacttagagcaaccaatcatagtgattaaacatggccaatttaacccaattctcaagcactcaaattgtgctatttcacaaaactacctgatcatcaaactgtctgcttgtttgttttaacatatccttttacactccattcaggtgtatgtttgggagccttatttggatcctggtatcttctatcagtcatatatctactgttgctgatattgtatctctgtttcattatctgacagctttatgctggaaacttctgcagaaaaacacacaacaata

SEQ ID NO: 12386 - DNA, 109 bp, Zea mays
tgatcgtgctcgaccagatgatcttcgacgtcccgccggatcagctcgccgacacgcgggtcgagatgaccttcttcgaaggccgcagggtctacgaacggggcgagtg

SEQ ID NO: 12387 - DNA, 94 bp, Zea mays
ggtagttttctaagcttgttcttttttgaattacttcagcaacaaacattatcataatccttgaattgatttgaatgaacacattgttttaggt

SEQ ID NO: 12388 - DNA, 553 bp, Zea mays
agctttgcacggcgcctcacatgggctcgtacgcctcgcctcgtcagccggacgctccgcagcgacaggtcgccactggctcactaacgtaatccactaatccctccactagctagcttgcctcagctcttttctaatcggcggccgtggcgtctgagccctgagtcagctacacgccctcgtgcgctcctcccgccactcatcggcggaaagcgcgcacggccacgggcaccggaacctcaaaagcgagggtgtggtgatgccataactaggaccgcgcgcacatgctggcatgcatccatgtccaggatatgcaacgacgcaaggatcatcccacatccacatccacatccaagcatggccggcgttgtctttttggtgcgtgtatattaacccgcgggccgtcgttcttgcggctatccgcacactgaatcacgaatctctcgagccgcagtccagtccatccggctgcaggctctctgctgattctgagtacgttggcgttccaggcgatagctagcttagcttggcttggcacagtcgatcgtctccg

SEQ ID NO: 12389 - DNA, 1500 bp, Zea mays
tttatctttatattttgaactatatagcaaattattatatattatattaaattatttataaaaaattctaatggcataactcacgaaaaaattctagctacgccattgtagactctatgtgtagttaactgatatagcctttattttaggaatatgcaacgatcatccctgctatttatgaatgtgattagtggaagtttattcttgatcattccagacttgtacttatcctttatggtgcttacatgtgaccacgtggatatgtttgcaagtattctgtttacatatgctatctcttacttaacataggtcaattttatgcatgcatgacttaccttaaatcctaaggattgatttagtgagtatgaatcatgagaagatatatgagaagaaatctccttgctactcaaagttaagtaacaaagagattcttcctcaatcytcttataatctctgtcggtcaaatcagtcctaaccaaataacttgtcaagatacagcggagaagtacaccctctgtcttaaaataattcttattttctcaaatattttttaccttttgctaaaaatacgtaataaatatcgatatttataaccacacctgtgactgcggcgccacctactatgggcagccgcagctggagggcctagagcggcttctggtgctggggcccgcgctggtacatcggatatgttcgcggcctgacgcgcaacaccgtgcgttgtttctggactccctaaccagcggcccgacgcgcgaaagcgaaccgaaccattccttccctcggtttctagcgcataccagcagcgcgcctcgcgggacccaacggcagccgcccccgggtcacatcaaaccagggcgcgctgcccacgggacgcgacacgacacgcaaggagtccaggttcccccacctcatctcatcttcctccccaatcccgacccccttttaaaagcctcgaccggacgacgatgcaagtccacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataac

SEQ ID NO: 12390 - DNA, 1387 bp, Zea mays
cttggtcataggcaggctgcaggcaggcgcctgctcgcatcgttcgttccgttccgttccgttccagcgctggccgatgggttcgaagtaaaaacggaccccggccgggccggcggccggccaaagctgtgcacggaaacggcatcgatccggctttagccaacaaaagtcgtcgagcagtagctttttttttttgcttccttttgtccagagagagcagtagaagatcattactttttgtatagaaggattacgaattcagttgaatttggacgccggaccggaggccggatatatacttaaccgctggcacgtgctggtggcttatgattattactcgcatcgcatcggcaggcgctgtgtgcactcgtcagggatcagctcagctgtcgcgcccaatgctcttactgccggaatgataagctctcatgcgtctgccgccctgcgcgggaatccgtcggtgtcggaaacttgtgatgggcacagaaccgcagaagggtttatcgttacgtacgtggccggataaagcgagtaaacccgttagccagttgcccagttcaaaatcttgaagtggacgcctgacctgaccacgcaagttaacgagagaagaaaaaaaaaataaccatcaacggtttttcttttgaaaaacaaaataaagaaggaaaaagccggagtcgttccaacagaaggaaggttggagtcgatacgatacgatacgatactacgacggcgcaactcccgtcccgtgcacacagctcacgaacggggaatgcgtcgcgcggccgggaacgggtccttgtcgatgccgcaacctttctgcgtcgaaattcttccagacctttcgtttcgccattactccccctgatgtgatgacaagagaccatccgcccccgcagcaactgcacggctgcggctgctactgaggctgcggcacacagggtgggagtggggagtgggaatgcgccgcgccgtgcagtaccgagagcgaggcacatggtttcagtgccgcggatagagaattccacgcgcacaggcacagcgccacggtgcgcgtacgtttcagtacgccgcctgggcaccgcctaaatgcaccggcctcgtccagtcgtccgcgaaagggcggtggtgcgtatgcgttccctccctcccgacccgggctctgctgcctctcgtgatctcgtcgcggaccgcttcccacccaagatttccactagtttgacctcccgaccgggttctagccgttccctcctcctcctcctactccaccccgcagttcaacggcaggcagcgtcaggttcttgatcgagttgctcccttcccttccttacccgccgccgcggcccacggtgcacgtgcatgggctgcaagggctccaagcacgcgctgc

SEQ ID NO: 12391 - DNA, 506 bp, Zea mays
ggtaatattgtcgtagtcgagttttcagaatcagaaacaaatatgtaacatgatagaattgtcacttgcgaggttgccgcaccgtagtttgtaaaacagaccgatgatttctctgaatttgtaaaacatcaccaggcaaataaccgacagcagttaatggcggcgtcggcccaactgagcccgcatcagaggacgcgcagaaatcgcctcctgattttgtgcgtggttgtttgggcggggcgtgcaattccccgattcgagcggaactcctcccatccgatccggcggcggaggacaatataaaagcgagccaatcggcgtctagctgtagcacctctgcgtctcaagattagagatccattagctgtagcacctctgcctcccacgaatcgattcgacgacatcttgctggtgagctatccccaatgtacaaaatacctgttttgcttagattttatacttacgcttgcgattttgaatcatggcagcaggtacaacctaccatc

SEQ ID NO: 12392 - DNA, 239 bp, Zea mays
gacgtggtgtcatgtgttttgcagaaaactgtcactaatcaggcataacctacggttattttctacagggacctggtgctttctacaagggattcattgcaaacttttgtcggattgggtcatggaatgtgataatgttcttaactctggaacaggtaacagaatgtgcacgccctctcattcagggtggcttttctaaaattttgttaatgtttagtgaaaactaaattgtagaaggt

SEQ ID NO: 12393 - DNA, 67 bp, Zea mays
gaagaggccttgctagatccggactgggtgttggccatgcaagaggagctcaacaacttcaagagaa

SEQ ID NO: 12394 - DNA, 163 bp, Zea mays
ctgggagattaggtgatgtaaaatcagattttaaaggtgaagaattattcaaaaagaacaatattgtgaaagcgaacctattgttgctacaagagagaatttgctaattgatctttcctgtggtgccgagtcgatagatgtgtcagatgtattggaatcttta

SEQ ID NO: 12395 - DNA, 631 bp, Zea mays
ggtgttgggtctatgcttcgtcgccgaaggtcttctaggaagaagcggttttcggctgaagctgtttgtatgagatggccgaaggttccttttcatgaagcttcggtattacaaaccgacttaaagatagaatgaccttttagtccataaaggtctgagtcaatgttgtaaacttttatgaggggcatgattgtaattcctcacaggctgtgtcctgtgcctataaatagtgaacagtattcctttactgttcacggattctggtaattgcaaccgcatattctggaattcaaccttttgtcaaggcagaggtattattgtattcaatgattgaatatattaagaaaatataatataattcgtccatgacttatttatctcttttgtaccttttattttatgtcatcttgcaatatctattgaaatcttagtacgaagatctaaacttcgtaattttactatcatcaaccttcgtccaagacccattatcctcaagggaataatgttttatggacgaaggacgttgacatttaacattttatgttgccttgttcttaattcatagcacttgagaacgagtctccaacattggcgcccacctccggtgaactcacttccactttttgagctg

SEQ ID NO: 12396 - DNA, 142 bp, Zea mays
gcactccctcgtctatagaaaaaaaattacgccaatgcaaactgatgctctcctttattttcttagaaacaaaaacaagaaatcaagaacataaacggtaggagaggtggaggatggatcgttgctggcaggatgatggatc

SEQ ID NO: 12397 - DNA, 1500 bp, Zea mays
aaggccgctgtgaattgctgatgtacaggaattgtagctcatctgtttttcttttctgcggaggatgatttgcagttaaatttgacattttttttatgttctccattaaagcctgttgtaggtatacattgcaagagtacaagacatgtattcgaaatttcaaaaattcatgaagactactgtagctttccttcatgctttcaacaacccgtgaaactcttcatgagttagaaaaaaaatggtgaatgccgtagtcatcaatgctctcttgaatttaaaactttttttaggtccgcttgaaattgttatccttaaccaaaatgtgttcaggtgttcacagcattgctcattgcataaaggctaatgtgtcttctcttctgtacctcaagagtacccgttttcccgtcggtattttaaaaaaatcttatatttctttctaatctaaacagtcatcaacacatctttatctttatatcacacgagcttgcactgtcgtatgtcacgtccgaaacatgtagatctatttttcttatgtctcgcctaacaatcagataaattaagtctttatctttttaatgtgtaactaagcaagtcaccgctgctgccgatattttaacaaagaatttataagatattaaaatcgataataatatatataattgtttgtttttatataatcgttgtatttatatgctttcgtaatgtagtcattgtactagtgttttcgtaagtgtatctccgctcatgtgagtccacattttttgtcatggagttcggctcatgaggcctgcttctgggattgttgacattaaattgtacttccctgttttttttatcgtggtttagtttaaaaataaattagtgaccgacaaatattcaaaaacggatgttgtatataaacattttttgcacatgcttatttctagcaagcatactagttgtataatgaatgcagaacttaattaaatatgtgggaagaggagtatcactaacatataactatgcaatataatatgcaacaaagaggaccacatgagttgtattaaaagacatgactagtctactgagccggcccttatataacaagacatttgcaaacttctaaggcacagttggaaatctagtttcatactgaacaaacgacagtcataagccataacctcaatttccatatttcttcggttctctagagaacagtcttattgcttttctccacccactaatgacatctttttttaacggaaagtgggtaaaagaaacatgaacaagaactaaacgataaccatagcacactattctttgtctacaaaagctgactctgcaagatygatggcccgagctagtgcagcagccttattctcgcattcacgttgttcgtcatctgggctactgtcggcaacaatgcctgcaccagcctgaagatgagcgacccactcccgacgcctatctgcgtctttgtatgagtacatcgtgttgtggctcggcgctgttgagaatacg

SEQ ID NO: 12398 - DNA, 286 bp, Zea mays
attcccagtacttgaagttgaatctttattaataaacccgcttcttgagaagccagccaattctgcccactttattacgccatccaagaaaccaagtccatacctggctagattcgattcagacatggacaccctgatcgatctcccagcttcctagtcctgtcctggctacagtgtagaagagcctatatataactccacattatcgtttcaaatgcatgcatcacactcgatctacactcacagagtgccggcccgttcttcactgcccacaaaggctggagcc

SEQ ID NO: 12399 - DNA, 1500 bp, Zea mays
gggccggggatgaaagggatgaccggatgagcatcttccgatggtcctagacagggcacacgtgggccccaccgtccaggtcactgtcgtggatggctcaccccgtgcctgcactgcagccctttccctagttacatcagcgagcgctagctatgccttgcctttccatcgagctgagctgagcatcatggggtagtgtgtgtgtgaggcgatagagaagctagtgctcataaccaaccacggaaccaccactcagtcctcctcctctaccggccctttcccttccgcgttcctacttggtcctagaaagagagagatctcgtcgaactcgaagggcgcatgctccggttgctagctacgataccgtgtgcgtagctgcggcagcccttggttagttctctcaatcacctttcagagttaattgattagttcgcgttcggtgtagcttcgattatatctgctcatggatgcatctctctctttgttccctatatatcccggccccctctttgttttctgtgtttgtttgattctttcctctctttaatttgctatattagaggtagagagatgtgcttagtatttgttgatgatgctctatttggtttcttgcatatgcatctccatgcatgttctcttctcctacctagctctccacatggtggcctctccctagctacctacacacctgctatagcgaggtagctccccggccggcccttgtgctatagtagctagctagcttctctcatcttagtttttttttgggatgcgctttgtttacgagtgcatcagccgcgcgcgcggctgggtttgtttggactttcttcctcctcgctccggccggcctcatcgtcatcagctcctccattttccccattactcgcttttcatttgttgtgtgttgctgtgcagagaggagacactaattcgtcctctttggcacacagatccatccgtgtccatgtccatgtccatgcatgagtttctttcgagtgtgctgcagcctgcagtacatatatactgtggtactgcttgtttgcattcatcaatttgtccgatccttcctggatggatagatagatagatacgatatatatagacacacacaacacacatcatgtatatacagacacatgtatagctgatgcatgcatggaattaattttgtctaagcttgacactaattccctcttctctcgtttgtcttttagatcgatcaatcgatcgcttgtgcggaaggagccggatcgagtggagtcaggtagactgctagcttccattccaacaagaggttgaggtacacacgcacaggcacagcgtgtgcgtgacttggactagtcgctgtgaccggccggtgcgtggtggcatcgatctttagcttgcttgctgattccttctttcctcctgtagctagctagatactccgtggtcgtcgtcgtcgttggacgtacgccagaagagggagctagagaagaataccgtacagctgcttccaac

SEQ ID NO: 12400 - DNA, 320 bp, Zea mays
ttggactgaaggagctgtagctagaagagggggactgaaggagcagtagtagcagtgtgctctgacgtgcaaatactgtgttttgacggctgagataaaagggtagaggtgaggtgggagggtttaagtgagaattttgcatctactgtgttttgacggctgagattgcatttttaacgatatgtccccttcccaaactacctgaacaagacaagacgggtgccagacaaattcagcaaacaagcaaaaggcacgaccaccaccgccggccgggaagcaagctcaaaccctaatcgccgtccgccggcgacgccagcacg

SEQ ID NO: 12401 - DNA, 1409 bp, Zea mays
tgccgaagcaagcgacgcctattgccttattgcctgcccggggaaaacgcggtgctccccttccccacggctcacgcgtcgctcgcttcgcttgtgcggccgcagctgggacgggataaccacaagacaaaaaccaccgggacacaccaaggcgctcaggcggcatggaatggaatcatccattccgtgtgcgtgcagccagcggcgctatccttcctccccccccttgctgccttgctgtttgctgctgcacgattcgctgctggatccgtgggcaagcaagctagcgccgggccacaagcttccgcaaccgattggttctgggcgccggggcgggggcttcggcttcggccttcggccaacctgcctgcctcctaccagtatccatggctccggtcattgcaaccccggcccgcccaacctgcctgactcccatcgaagcttggacgccaagcattgccgccgcgtcccctgtcaccggctcaccgcgcttgcctcccagttccacgatcagtgggcgtggataccaagtacatatattatgattaaacgctggacattactttcttcgcctgcatgtttgctgaacgaagggcgtttcgtttctagagaaagatatcgattgatgagccttcgttactagtacatattactagtatatagtagtatattactccaacaacaaacacacgtcgaggtaatgacgcctctctttcatcatcactaactggagcaataattggagcaccacaaatacctttaaacaaatatcagtgttatatttttttaaaaaaaaaagaagaagtacggagtatatataaaactactgctatcagtattgatctgacctgaccccacaggagaacgcgcgaacctcctcccgccctggtagtagtctgcattctgcaaaagatctgcacagcacaggcatgcgggctggtcacgccgatcggtgccgcggccgccgtctccccccaccctgtcacctgataaatacccaaaccacccctgctctccggagacatcagcggctttgccactgcacgcagcgcgccacgccactacaggccacgagagggcagctaggtcgtttcgcacgggagaccacaccgcggtggacacgtaggataacgttcgcgttcccgtccggcacgtcaccggccgcgcctcctttaaaacccggtccccctcctcgtgttcttcttcccaacagatcaagcctagcaggaaataaaaatctgtaagagagaacaaaaaaaaaggagtcaatcgccggcgacgggtacgggtgtgtacgcctgaggcgatcggcagagaagaccgagaccgacggctccagtgccgctgtgccactgccagtctgccacagccagccgcctagcttgatccgccttttgtgctgtgcggat

SEQ ID NO: 12402 - DNA, 1500 bp, Zea mays
atatttttacaatgtaattttctgttaaatttaaaatcctttgactctaacttaaaataacactccctttgtttctatttataattcgtttaactgttttacactaagttttactagtttgtctaattaaaaaaataattattattatttattttaactatgatatcgtttatcatataatatactttaagtatagcattgaatttttcatttttttaaatttttttaataagacaagctggttaaatttagagtgaaaaagtcaaacgaattataaattgaaatgggagagtatgatttagaacgagaagcaatattttattagcgcatgtacatacatatatgggtgttgtaatgataatcaagtactcccttcgtcccacaaagaatgttgtttgacttttttagtatgaagtttaatttgactggtttgtattattcaaaaaaatcataattatcatttattttcattttgatttagtttatcatataatttactttaactgtgaactgaatttttctatgttttcacaaatattttgaataagacgagccggtcgaacttgaagtcaaaaaaaaaatcaaacgacaaattaatagtctctaaaattcccgtaaagcaaaatcagtacacctttcggttttggtacattattgtgttgtgttgtgtcgtggtatgcaggcttgaccaaattgacctttcaggataggaataatttcagacaggaaggggaaaaggttgctagtacagcaaattcgtttgggcgctttggttgtgctatgagcaggcacatatatatctagactgattataataggtaaacggatcacctgactaatttggtttactttgaagaattagaatctacctaatagattagaccgtttgacttagaatttgtcatttcttaaatttccaatgtttagatataagtctataggactgccatgatgtgcttctataacttaattggtctgtgcgtaaagtatgattattaaatgaaattcaattcccaggatccaaacatgccagtaaaattaatgataaagatcatgttcttcacttctttgggtctgctgagcccattttaatcatacagattatagtttgaaggctaaacggtatttcagttgtttacattgggtattaattaaatactgatatcaggcatggtaggacctgaatcggtaatggtcgtgctcgggaaatgtctgacttgttcctaccacttctaactccaggcagttatctgacatggaggagcacatgggaagacgaacagtcggcggcctgctattaaccaagggaggatcaattcttctcttcagagaggacggttcgcgccccagggccaagaactgctgctcgcgccatggctgcagtggtcatcattctgttggcaaagccaaaggcaaggaggtgcacagggcagcggtggccaatgaatcaacaccgggctaccccacgggagaccaaagatttgtaggaatcccgacaga

SEQ ID NO: 12403 - DNA, 112 bp, Zea mays
gggtttggaggcggatccgatgttgtcatgtgtaggttgtaagcgggcaatgtgattggctgtgtatctgcttcgctcaagttgctttatgtcattcctaatggaataggaa

SEQ ID NO: 12404 - DNA, 367 bp, Zea mays
ggtatggatttcaggtgaaccacttaaaaaataaaaagggcatacccagtgccgtaggcttcccgcactgtgcggggtcgtctggggaagggtatctttaagcgtcaagtcttacccgcataatatgcagaggctggggctcgaacccgggacctttcggttatagacggtaggctctaccgccgcaccaagcccgcccttgaaccatttaaaaaatttaggactcaaaaatacagtttgacagttgatggacctagatgacacctccttaaaaaatttaatggacctatggtgcattttaatcttttgttgatcgactatactcaatgttgaactctttaggtactctctttttaaactcggaacc

SEQ ID NO: 12405 - DNA, 1179 bp, Zea mays
gatatttcttcgcggttgctagacttgagagtcgcagttttgcatagtcctatattctatctgcactaagagtaatatatacagccaagcggacgtttggtttaacatttacaaggtatgtttggtccttttgttttttggaattaatggttgtccgatgcttgtcattcatatgagttctaatatcatgcccccttaaagtactcatcatcaaaagtttccatgtgaatgttttaaatgtagatttaaagggttgaaagacatcaaacagttattcaaacatgatcttaagtgtcgtgaaagactacaagtgaggttcaacttggcaaattgtttttctagtaactaaggagcaacaatgctatgtattttagcttgacttatatatctaagtacttacatttttggaatcgggcaaacagtgatagtttgaatcacatgttttgccaaaaggaattattagaactgttcaaaagttaggaaaaaatacatatttatgctttcttatgcacgggtaaattgctctgttcatatataaaaaaaataattgtagtattattgcttatattgattttaaatgatgaccttattagatgtgccatcgagaccacatatattagcattttgtaactaaatacaatgcatgaatatatatagatagcctttacatcgtgctacatgcttcctagaaataaggaaccattacaacatatatatttttgatgatgtacaacttcgtcatcggatataccgttccttcttttttacatacattttgataagaatgtcaaaatgttaaaaaaatagcgcgcgcatggcgcgcgttagacactagtagatttcagaactatcatgaagcgcgtgctcgctggttgttagttgttacagagcaacagcccagggaggccaagatgctacttagctactaaaaccaactgacaacaagtgcacagcccagtgggccgctaagctgcaagaaaaccctcgcccctcgttctggattgagattctctgcagaggctgcgatgttgggccgtcctgccctgcccggtgggtatatgtaagctcagaccgccaccggaaccttctcgagcccgcggccgcacacctccgcccgaagccgccagtcggactacgaacggcggcggcgcctcggctcccctgatctccctcaccgga

SEQ ID NO: 12406 - DNA, 382 bp, Zea mays
gatatgcctctttcatgcgcggcaaggtcctcctgtaccgatgtctttccttgtggtggcgcagggtgccatggcactgcattgccgccacacttacgatgatgatgatgggttatggattttgtctacaatgtcagcaggataggctcacaattgccccctgccctccggtttggtcgcctctcaggttttcatttggtagttgttcgcagggaaccatatgagaattgcaatgtcaatcaggtgtttgccaataataattgggtggtttctgctcttgctctgatcattaccatgcgttttttattctgttggtgggttggtcgattgattatctcctgcagtcctgctggcactgccggtggtcgtttgattatcatgt

SEQ ID NO: 12407 - DNA, 335 bp, Zea mays
tcgagcgcctcctctccgggctgggcgctggtccgctcgtggacgtcgagcccgacaaggttaaggacgagatccggcgatgggccaagaaggtggcggctctggtgcgccagctcagcttcggcgcctgggcggagaagagcgacggcggctcgtcggagaaccacggcgcaggcgatgatggatacgagagctgagcacctagactgcagataactttcgcgggcagtaagccagtaataactccgctgatatggtggcagcaccgggcaaaagcaagcgcaaaattcattctcctttattcgtttgttcgtttctaagggcgctgatactgt

SEQ ID NO: 12408 - DNA, 1500 bp, Zea mays
aaactccagcgtgtcatgcaagttccattatatatatttttttatataagcaaatgcttcaaatatgaaattaattctcccaaaaataggtaagaaaaataatttccagtatataaaatcctttagggagtactcatagatatataattcaacaaaaactaactaaattcatattgtaataattttatttaatctttattaagaaatatttattttaggagatataacttcaaaggcaacaaaagatcttattaagatatactctaattgaaaatctttagagaattttactaaattccaaaataagattttggggtgttacaaacttgatgcatgcttaattgctaaaattaatatgggttggttatggcaccactgactggtccatgttgggataaaaaatcttcataagctcctaaagggtgtacgacgtctcgaaaactgttcaaactttttaaaatttgaaacattagaactgagtttggatccatacttcttgagcctcttctaagccacctagagctaaagagaattggtgtacaccatgctaaacttattagacttttctaggtaaagttactagtttataccctatttatgctattaaagaaaaaaataaagtcctaaactatcctaaatgtctatgaactctaaacgacacttaaaactcgtctatctttaaccttgcyttcaccttttcaaaaccgcaacaaaatgtatgattagaggcttaaaaaaacatatattgttctaaaacaatctccattattatgacctaacttaaacatacatttggaaaacaaatgtttgttataataatcttatgttgttaggccccgtttcaatctcacgggataaaattttagcttccggctaaactttagctatatgaattgaattgaaatgctaaaatttagcttcaattaccacaattagctctcatgtttagattacaaatgactataagtagctaaaaaaaagctgctaaagtttatctcgcgagattggaacagagacttagtacattgaacatcattagcatagaatatatatttatgttgaaaagtgctagtacatgagatacgaccataaaatttgttgggatgttctaataggaaatagtggtcaaagtcagagatgtgccgctgtccataacgtcaagcatttgcaaactggaggggggtaacttgagtgaggacgtttttacgtttgactcgaacttgttccatctcatagttacctagtagtaatctgtttagctgcggggtctgcatttctggtttctggtttgtgccagaaccaggaggcaggacgarccaagggtctccgctgttcgctccgttccgctcggcggcgccttccaaaccgcacgtccgcagtccgctgtccgcagcgaacacctgtcctcctccggtcctccctgtgcggaacagtctcgccaatcgccatcactagtgtcgatctgcgccggcctacagcctacgtccgtcgtcgtgtgcg

SEQ ID NO: 12409 - DNA, 416 bp, Zea mays
tctttctctcattgtactctcaaagccttgtaagcgagcaaagagacaccaatgtgtggtgctcctgcgggtctagtgaccccaggaaatcaaggaaggaagctcactcggtctaagtgaccgtttgagagaggaaaagggttgaaagaaacccgatctttgtgaccacctcaacggggagtaggtttgcaagaactgaacctcgataaaacaaatcaccgtgtcatccgctcttatttacttgtgatttattttcgccctctcttttggactcgattatatttctaacgctaaccccggcttgtaattgtgcttaaactttataaatttcagatttgcctattcacccccctctaggtgactttcaattggtatcagaggccggtacttcattaagagcctaaccgctcgaagtg

SEQ ID NO: 12410 - DNA, 1500 bp, Zea mays
ggcacaagggggcgaggaactcgctgcacagatgatgtcacaccctccctcattcgaaggttgtcagaggaggagtcgaggtgctcaacagtttggaccatcatggtaagtaataaaataggcaaaaacctaggctaaggccccccactctggtgcgacaaaggtcaaaggtaaactctagatgggtggaggaatgcacccgcctaatcctaagaacgagggggctacctaaggttagcctatggagatgcaagaacacaagaacgcgcagagatttagagtggtttgggcccaccagagcgtaatacccctacatccactatgagttgtattgcctgagtgtggaccgtggagtagatgggtccaagtgaagatgtcagagagcttgtcccttgtattgcatgtgccatctcttttatagtccaagggcggcacgttacaagggtgctgagcaacaacgacaggtgggcccccaacagactaatattaaatatatactacatagagcatgagcaatgaagctacgatgtaattggatgaatgtattacattgattgtttagacagtttatatagaatacatgacttatgagataagacaacctataagtatatagaccaatctatgagacataatatatctaaactatcaaatatacttgttagtctacgaaacacaatatctaaaccaccaatcaggatgccggggcaatgtcccccgtaagggctggtcagggaaatggagaggatccacccttttctattcaaatttgaatgagaacatatgtaatgcacatggaattttagygcacatgatacacatattaaatcatcaccactcattttagatctaacgtctgcagttgtttggtatatttgctaaggacaccctccgacatgatgggctttagtgatggaaggtgttatttgtaaattacaatgatcaaccagagacgttagatctgagatggatagttgtaatttaatatatgcaccatatgcactagatatgtcctcaatttgaataggaagggattcctctccatggatcccctctatttacctggtcaccaaacatccctaatcctccccaaattttataggaactactaatttctctaacttaaaaaaaatctaaaatagtatactttagcagcctctcaatctgatttgttcccccaaatttgaatcctggcttcgctctgccacctgttgtactctacatggtgcgcagggggagagcctaatctttcacgactttgtttgtaactgttagccagaccggcgtatatgtcaatgtataaacacgtaataaaatttacgtaccatatagtaagactttgtatataagacgtcacctcttacgtgcatggttatatgcgacatgtgcagtgacgttatcagatatagctcaccctatatatatagctctgtccggtgtcagtagcaatcaccattcatcagcaccccggcagtgccaccccgactccctgcacctgcc

SEQ ID NO: 12411 - DNA, 124 bp, Zea mays
ttatcaatcaacctttaccactaatcgcttccactttggttaaccacccgactccacctaatatagccttccttttccgtccatggccgcgcaaccctaacggcgcccttcccgtgccgcgcgc

SEQ ID NO: 12412 - DNA, 346 bp, Zea mays
cgtacaagtgagcttttagtttttttttctaaaatcaagattactgaaacacaaccaatttgggtcaaatcaatagagcaacaaacctccagcttccctgataaatggtgacgatgttgtccatttattgtttgcccagtactccagcagagtaggtacagatagaaacatgacacaaatcaagtggggatgtcgtgcgcttgagactacaatgatgcaaattttctcatacaacggatggagttttagtaatcgaattggtttttagtagatttcgaaatatggttgttcttgagatattaaacatcatgtgttttggtttgagaagtaataattgaacagccac

SEQ ID NO: 12413 - DNA, 76 bp, Zea mays
ggggcagtccggcacccaggccttcgtcaagtcctacaagaacctcaacttctactggatactcgaagccgaacac

SEQ ID NO: 12414 - DNA, 642 bp, Zea mays
  unsure (1)..(642): unsure at all n locations
ctgcagcgacaacgtaggagcggcaagctacgactggcgcgtgggcacaagttgccagtgagaccgacataagggccccaccgtgccagtgacgtggcacgcgaatgagtggatggcggctagggtttggggcaggcgcgcatacaagaaagaggagggggaaaatgggccgattaggatggttgccggcccatttagcttagaagccccttttttatttttctttttttcttttcttcctttccaaattcaaatttccctttcaattttaaattccaatcttgtgtcaaatttattcccaagttaaaagtgcaatttgaacctacccaaaaataagatgaatttatttatttataatcttattttggtgttgtataatatccttttctttccttctctattttattttctattcccctttctcttattctcaaatcccaaactaaatttaaattcatgttttgaactttgaattcacaattctatcttgaatgatacttttgctctttgaaattatatntgcatattatttattcttcttcccactattttattgggaaatttggatccataccattaaaagatcaccactttggatccataccattactatctcacttacatgtgggtccacatgagtca

SEQ ID NO: 12415 - DNA, 52 bp, Zea mays
cgtaactccagcctccagcgccacacgtacacctccgccggatcggaagaag

SEQ ID NO: 12416 - DNA, 396 bp, Zea mays
tgaatttatgatggtcacatcgcacaagggacttggaacattacctctactcaaccagtacaaaattctaatgatggagagcaactaaaaaccatagaagtggaagatgaagatactaatgaaccagaagaagatgcaagaatagaacaagatgaagatatagtaattgttgaaagggttgaacagaggttacctaaaaggtcaggtgcaccaactgtcaatcaagagaaggagacaaaaagagtgaggaaagatgcactagaagggctgatagggaggtaccttgatgtgaaaacgaagcaagttgcagatgaggctgcacaatcagcaaaagtaaaggatgttgctcaagataatgatttttctatcaagaggtgtatttctgttcttaagact

SEQ ID NO: 12417 - DNA, 85 bp, Zea mays
ttgttttgcagcaattgcaggtggacgtgtgtgagagttgcagttgatcggtggacacagctagcttaaacgcgcgcgcgcggca

SEQ ID NO: 12418 - DNA, 987 bp, Zea mays
ctctcttaatagagtagtatatattatgaaatttagagtttattgttatccctacttatagtgcactctgcaatagggcattggcgctgccatacgcccatacgttataaacattctaatgttatcacaaggtatatattcagccgcccatctagtgcatcatgaggcttagttatttgttacatctcattttccatatttactttttctatttggacctaagttatttgttgactatgtgtaaattaagtctttttgtttgaaatattttaattttcgttccataaaaataatcttgataatttgtttcctttactgtttttaatttttttgtatgttttttctttgaaacgtttcaatttgccttccataaaaacaatctgctgactaatttgtttgattttgcctttgattttttttgtctgttttatttgctttttctttaaaattttcaaatttgtcttccttagaaagatctggataatatatttcttattttatctatgttttatttggtttgtcttttaaatcattcaatttgtcttccatagaaatattctggttatttattttgtttattttatttaatattttttgtattatgttaataatttttacttagttcatttgatcttgattaaatggttatgagaacccagtgtttgataaattgatagtcttgaaacattgcattatctttatctgaaaagatttgtgcctttgtttattgtagccgtctacactcgagtgtcacgagacaaaccacgttagatgtcatatagcccgagatctgcggatctcagtttcctgttttatttatccatgaccatgagccgacgaagtggatagagctattcttgtgatcggtgatgtacgaccttttgtttctttgcgaatcttgaaccagtatcaatcgcaggcagagctttctggcaccatgcgacatcttggttccgttccaaagatccaagctccccacccttcctc

SEQ ID NO: 12419 - DNA, 110 bp, Zea mays
agtccctcatccgctctggtgatctagacggcgcctcagccgctgcccgcgccgccgtctcctcgcgcgtccggcccaccgtcttcacctccaacgccgtggccgcggcc

SEQ ID NO: 12420 - DNA, 1125 bp, Zea mays
agccacaactgtctctacttaagacgaccatgtgatactaatgttccgaataaagcttttgcacatcacattaatgtgatggatgatattgtggtcaagcaggcatatggtagccaccacaaaggatatgaagcatacccaaatccactatgaggagtgtgtcgcgtacctatgccacacctaaatgtgctaatttacctgtaagcattataaaatataagcaattacaccgtatctgatggcatggactcgagtacataactatgatatgatatatttctcactgccgcaagatatgcatattacaatgacatgttcaagcgccattgtggtccgcgtagagtcctcgtctctaacaagatgaagtaatcgagcatgttcactacgaaccaacatgtgatcctcctcttcttcgagctataaaatattcatccagcttaaatttcaaaatatgtgtgtcagagttaaaaaaatattcgattcaaatctaaatatcagttctgtattcatatcctagaatattcgaatctatatttgaattcagattacaaggtagtgaattgtgacatgtattcgttcctatccgatccgtcgtttttgagcactaggtgcggtcactgtgacgcgtggacttggcttcgcccactgccatcgtggacccacgtcatcagcaagtgtccatatccaccacccgacccgacgaccgcttgccgtccgatccgtgtgctcccgagggcaaggatggcatttcgccacgcgagatatttttcggtggcctgcacaggccggcagtgcagcggccaaaacgaggtcaggtcagtcacgctgggccccgcctcacgctcccgtcctgctccgggtcccaacaaagccgtccccgggaggtgctcgtgtgctcgtagcgcggtggcgaccccgatgccccgcatattccactgggcgtccgcgccgtcggatgggatcaggacggccgcggcggccccgcgctcggctataaagacgctgcgggggacgcattccctctccgtgctttcttagaggtgggttggcttctcctccccctccggttcgggttcgggttcgtgaggttctccggggttcgggttcgtgggtgagcggatcgag

SEQ ID NO: 12421 - DNA, 762 bp, Zea mays
gtcgacggggctgaagttgaacggaaggaagtaatcctcctgcgtcgctgcgtggagccttgcgccgtcgtcccttgcgcgtgcgcttcggcggctatccaccatcagcgaagggaagcaacgcgttgcgatcaattgctatctggagattgtggttttcgaagaaccacggtcaaattgctgtgaattaatttatagggaggaaaaaggttgttcgagttcgtatcggcgggacatgctacgtgtttatccaaaacatttaaatcggtgttgctggcctgccacagaatctgaacaacccagctttcctcgctatctgtttcgcgtctccgctatcggaggaactgctgccgccgcagcggaaccagctctcaacctccccttcgccggggacagccgcgacttcgcgagtttatcgatgagataaagcaaagctgattctttctgtagtgtcagccgttgcttgcatgccttgctagttgttactcatgtatgacgttttttcctccctcaatgctagaaaatccgcactgttgagcaagrtgtgaagayaataaagctgcagattgtaagcaatcaactgtagtcaatgttacattttttaacagttagaagctttaacactgatgtttctgcacatttttgtgatttagtgggatactgctggccaacaagagcgttaggaccggcacaagcagaagcagctactaccgtggggctcatggcatattgttgtgacacttacccacggggtacgcgggt

SEQ ID NO: 12422 - DNA, 149 bp, Zea mays
ctgaatgcttggcgactattcagtgactgcggttggaggtgagcggttgccctttccttctataaataacgtcgttgtctttctggctttttcacatctcttcgctgttctctgctgcttccatctcttttctcccttctgtttccacc

SEQ ID NO: 12423 - DNA, 1141 bp, Zea mays
ctgcagtgctatgtaatatagatgctctagaattaccatctcagcatactatacaaccttctaagcgttgtgatttgttcaaatttgctcttctacttatataactctacttatataaccatgtgctctataacaactattttttattatatataaatatgatgtcggtatattgaacaaataaaactgattgtaacaatgattgtcaacactacttggtacgcgcgtcatgaaccatgcacgaaggaagcaaccgttttgaatcttcgttacaccatttcaccatgaagaaacgagttgcgtacacatgacatgggtagcgattggtgtgagcaaccaaatagtttcatgtttcagttatgacttgtgatgggataaactagtttctagattccaggtgatactatgagtaataatacagtacttcttcctttcatttttatttatcgtgttttagttaaaaaataaactaatcggtgacaagtatttaagaacgaggtagtactatatttcaattataatgtaacaaataagttaaaatgacataaaatcattttttgcattcattgggaaaaaaacaatgcgcatcttgaatttcccttcggaaaattagaatcagagttttttcaatattgaaaactcatatatatatatgaattcaaaagttaatccatctagcaattgcgattcacgcgttctattaacaaaagttgaataaaaaaatattacgattttatctatttgaaaaaaaataaaacaactgacacaacgaaatgtgccaaatcaggccgtgggaacaacgaatgtacccataggaaattttggtccccatattgcagctttcccaaccaaccatgaactcacccgcaccacgccgttaacgggtccagaacctcgcttccaatctgccctcccgtgtccccctccctgtccgattccccacagtagcgcctcgccctcgtcctcctcctccagtccggatcgccatttcccaccgatccgtcccggcatcggcatggctgcgcccaagccaaaggcgccggcgcccagtgcttcggcagcctagcgtttgtttgcctccgaggatttccgcctatcgcgttaccggatcttcggtgggccggcgaccctctacgccact

SEQ ID NO: 12424 - DNA, 264 bp, Zea mays
ctgcagccggtgccgccagcaagacatccggaccggacggatggcccctgcggccctgcccgtgggcggctggcctctgagtggttgagtcccttcactatgctagtataaaattgacaagagacaaaaactaatagcctctcaagtagtcttggcccctaatccaatccagcttccaccattgcgagagatcatcagaggatcgtctccagtcgaagcgaaaagcgaaaaggagaaggggcgggggattgcgagcctgtgctg

SEQ ID NO: 12425 - DNA, 266 bp, Zea mays
ttcagctcttttcttttttttcttgcccagcctaggtttcatttggaaaaaaaaaatggctccacaattgcaggcactccacccaggtgcgcggcaacgccgtgctttgtttagtgtggctggcgcgcgacaagaacgaaaccgtcggaaggayaaaacgggacgcgcgacgtgaccttttccatacttgcatgcgtgtggctggcgcgcctcctagcaattgcaagtcggggaggcaggccgccttcaaacggtagatctagccg

SEQ ID NO: 12426 - DNA, 590 bp, Zea mays
actcatctaatatttcaaaaaaaatatctctagtacttaaggcggaaaaggtagcctgcgtctacctaaaattaaaaaacataaatgcctcctaggggatttgaacccacaacctctcaggcaaatgctagtagtagctaccactacaccatatgtgtgtttatgtctacatctataacagaaaacacatctactacatctctctctaagcccacctgctacccttgcacaatgcgtagtagtagataagtatcaccgagattcttgaattatatttttggatgaagggagtagtatttaaagaagagccttgcatgcaatttcttttatttgaataatgtttttaacttaaattctttttttgcatgtgtgacatttattctttgtaatattttttccatggatctgacttgtgagtcatttttataaactaacgccaaacatgaattcatgtttcttacttaaaaaccccgaacaaacactattagcaggaggcactcgcgttggggtcgctcatcgacgacaagaagaaacttggcgactgccagttcgacctctagaagcagtcctacgtggtcgcatgtgccgct

SEQ ID NO: 12427 - DNA, 787 bp, Zea mays
gtactggacccgacacaattcaacatctagttagcgagaattgggagagttgataaagttgttccaaacgtacccttaacttatgaagaactagacttttttagagctagagttcaatcgacggggcacacaaaatgcaaagcaagaggtcggcaaatattttccccatttcccttggcgctgccgccccaccaaaccaccaccaatacaatacaacatgaatgtcactacctgtgtctatagattgtcaaacgggctgagccagtccaaccacaacttggcccgctagatccggctgctaatagggtcgtgctggatgggcccacgtgccgcggcagcgggccaggcacggtggccggctaaccggactgggccactagcatgacggtcaatttgaatatattgcatatatcaagaaaaatacgagggggaggagcctcgaacctacaaccacctgtgcaaagggctcatctagctagggcggctaaaatttggttgtgttatataataaatttatgtactaaatatatgtgtggtattaattttaaaataaataatataattatgtcgtgtttctaccgacactatgggtcaagagagcggttttcactataggagtgccgtacggtctccgttcggtgtctaggcggccaattgtccatctatgcctctgtctggccctgccgcgccgtccgcacgcgcgcgcacgacgcacagtcacagatagatacctttcctctcttctcccgtccggccgtcccctcttccgcggcaaccccggcgcggc

SEQ ID NO: 12428 - DNA, 204 bp, Zea mays
cgacactaggagcacctgacctcttctacatgcatgcttacggttgcttgtttgcaggccgtggattttgatccagactcactgaggtcgcaactgccgaaagcagtttcggcgctagaataggctacgtcgcagcgcaaagggcgggtttatgtccactgcaccgctgggcttgggagagcacctgcggttgcaatcgcttac

SEQ ID NO: 12429 - DNA, 993 bp, Zea mays
ctctcttaatagagtagtatatattatgaaatttagagtttattgttatccctacttatagtgcactctgcaatagggcattggcgctgccatacgcccatacgttataaacattctaatgttatcacaaggtatatattcagccgcccatctagtgcatcatgaggcttagttatttgttacatctcattttccatatttactttttctatttggacctaagttatttgttgactatgtgtaaattaagtctttttgtttgaaatattttaattttcgttccataaaaataatcttgataatttgtttcctttactgtttttaatttttttgtatgttttttctttgaaacgtttcaatttgccttccataaaaacaatctgctgactaatttgtttgattttgcctttgattttttttgtctgttttatttgctttttctttaaaattttcaaatttgtcttccttagaaagatctggataatatatttcttattttatctatgttttatttggtttgtcttttaaatcattcaatttgtcttccatagaaatattctggttatttattttgtttattttatttaatattttttgtattatgttaataatttttacttagttcatttgatcttgattaaatggttatgagaacccagtgtttgataaattgatagtcttgaaacattgcattatctttatctgaaaagatttgtgcctttgtttattgtagccgtctacactcgagtgtcacgagacaaaccacgttagatgtcatatagcccgagatctgcggatctcagtttcctgttttatttatccatgaccatgagccgacgaagtggatagagctattcttgtgatcggtgatgtacgaccttttgtttctttgcgaatcttgaaccagtatcaatcgcaggcagagctttctggcaccatgcgacatcttggttccgttccaaagatccaagctccccacccttcctcatggtc

SEQ ID NO: 12430 - DNA, 376 bp, Zea mays
cttagcccgagtccgagccctgagtcgggcggagcggagttcgccgtcttccggggctgagcccgagtccgagccctgggtcgggcgaagcggagcttcctatggcgcctgtggccaggcctgactgcttgtcagcctcactctgtcaagtggcactgcagtcggagcggcgcaggcggcgctgtctttctgtcagaccggtcagcggagcggcgaagtgatggtggtcacttcggctctgtcgattgaagggcgcgcgtcaggataaaggtgttaggtcacctttgcattaaatgctcctgcgatttggtcagtcggcgcggcgatttggtcagggtcgcttcttagcgaagaaagggcctcgggcgagccggaa

SEQ ID NO: 12431 - DNA, 325 bp, Zea mays
ccttacggaagcacaaggacgtcagcaaagactcgacagcttcgacagctgtccttccgccaggctccagcgctcctcggacggtcacgacaccacacgaaccgggtgctaaaacctctccagctgccacgacggcatgtacttagggcactagctctcctccgctagacacgtagcacttcgctacaccccccattgtacacctggatcctctccttacgcctataaaaggaaggaccagggccctcttacagagggttggctgcgcggggacgaggacgagacaggcgctcgcgtaaggccgctcgctccctcacccgtgtgg

SEQ ID NO: 12432 - DNA, 716 bp, Zea mays
tctggagcttgacaggaagctgttcgtcaacacgcagtaggcccctacctggcgcgccaactgtcggcgtttcgagaccgggggggtccctaagccgacgagtgaatgtcatcgcgtgccccagcccagatgggtcgagcgcgagggcgagcgcgaaggggggaagcgaggcggccggagacgggcgtgagagaggtggaaatcccgcggccttcgtgtttgtcccgcgcccaggtcgggtgcacttgcagtagggggttacaagcatccacacgggtgagggagcgagcggccttacgcgagcgcctgtctcgtcctcgtccccgcgcagccaaccctctgtaagagggccctggtccttccttttataggcgtaaggagaggatccaggtgtacaatggggggtgtagcgaagtgctacgtgtctagcggaggagagctagtgccctaagtacatgccgtcgtggcagctggagaggttttagcacccggttcgtgtggtgtcgtgaccgtccgaggagcgctggagcctggcggaaggacagctgtcgaagctgtcgagtctttgctgacgtccttgtgcttccgtaagggggctgagagccgccgtcgtcagggagcgtgcggggagccatcattgcctatctggcggagcgagccagatgggatgccggtctcgtttcccgcagcctgagtcagcttggggtagggtaatg

SEQ ID NO: 12433 - DNA, 594 bp, Zea mays
tgcaggcgctgttcatcgccttccacttccagccgggtaatcacgcgggcaatcaccgctttattggtggcgggctggccatcatccatcagctcgcgcatgatggcggccagcaaatcgctctcgtgcggcgcgtgccaggcggggctgttgaaatagtcggtaatcgcccgactggcgctgtcatggtgcgttctcatagccgacctccgcagagacaacgaagcctgccaccctcgacgggcagcaactgaaaacctgaattaagcatgcggactgtccaggacgggcagcgcctcgccagtgatgactggtgattttttaaacatagatgcggtgtggaatattgtcagtaacgaatcgtcatattttttcacgtttgccgtctctcgcgatgcgcttatcgggccttaggccaggtaaccgcacataaagacactacaaaagtgagacatcgccctatttgctgtgagcagaatcacgcccggcagcgaaaaactgcgttttcatccgcatgccatgttttgccgtccggtaatgttacgaggttgttagactgaaccctcgtttcatttttttctgacatctgcgctc

SEQ ID NO: 12434 - DNA, 1154 bp, Zea mays
aaccaagcaacacggacagacgtggttcatatttttagatcatcctgcggtcctgcccatggaatctttgaggacggagatccatgccatgccagtgccatggaaacttcttcccaaggagacctcaccttggtgcccacaaaaaaattaaaataaagagggtcattatttggacgccagcaggctgttttactcgcatggttcgtacgctgccagcaccagcgcggggaagatctgtggttaggacttgacgacgacgccatatgcatgaggctctccgacgacgaccacggcggactgtcacccgtgttggattaaggtgggcttagcttaattgatatttaataacattcgttgttaatgactcattttaatgctatagtgcactaataatttaacactatattagaattttaagaaacaaatcaatcaacttagataggtggaccattagtgcatctattaagaagttgagaaaaaaggacgaagcattgtcgcatgcgcgcgcccgcgtcaccggtcgggccgaggccgtggccatgcccaagcacagagaaagtgggagagcagatctccgaaatcgccgtctccagatatacacttgtgcgagtgtgcggacgatatcatatttttggggaccgtactcgcgactgctcgtgttatccgttcgacacagcagcgcctcatctacatcctgctcttcgtcgtcttccctagacgacgtgtgctgttgttcgtcttatgacgaacgttcgagagactgcatcgattctatacggctacatcgaatatacacacgagatgtctcgtatgaatggagctacttatgccttgagcatcagtccctttacagagtctctctacggaatactttctgttcttcgtatttgtgcatgttttattgttgttttctaacaatccgcacccccagctgcgcgcgctctcgaaggttagttatcccctctctatgtatttgaacctagcttgacttctccgatccccctgcaggtttggcttggctataagatgagctgtgatagattattctctaatctagcgtatcttcgtctatcatcacgcactccatgctttttgtcacgaaaactgttagccggcaacaggattaacctcccaactgcagccgaaccacgcac

SEQ ID NO: 12435 - DNA, 762 bp, Zea mays
gaatttttgtagtcatatttataactaagaggtggtttgtatttgttttgtaattctagtataatccttcaaatacaattctagtataagtttatggcatgataacatggtataaaatatattatctgagggtacatttttcatattttccattgttgtataaaattcgaatttgtttaaaaaatcggatataaactttgtcaaattggttttagtgccacactcatacttatatttaccttaaaaattttgtaaaaaaatacaattcaagagtcaaatcgctaaaaaaacttggtgccaacaaaatttctagtctctgtaaaatgcgtaacatcataggttattcacattagtagcgccacaaaggcacatgctgcgagattagatctgtttacatatacagtgtcttagaacaagtttagggacctaaacattcgtttcaagagtttgggatctaaatgatacgaccgaataagtcttgggatctaaaaatttgttttgacagtttggggacatgaatcacaccgtggaacaagtttaggacctatgatgatgtacttcactctttatgttttctctcgggcatcaagaaactgtcactcgccgctgggtccgcctagtcagcgacgcaccaagcccagcaagcaacagtccaacagccaacaaccagccagcgcgcgccgccaccgacacgcaccgtccggtccgccgctgcgttgcctttgccccctcctcgaggctagccccgcctcgcgggaggag

SEQ ID NO: 12436 - DNA, 552 bp, Zea mays
ggtcaatcaagcctaaactgcataggttttttggccgagtcaccttaggtcaagctagaaggcaatgtcctcctctggcatttttttcttcctttccacaagaaccctcttcgaagcttgtcaatagctttgatggcccacgtaggaaggtctagagcggtagctgcataaatcagttttgatgtgatcacaaactgaacatgaatagacctcccaacccttgacataagctccgctttccagccaggcaagagagaggctacccggtcaacaatagcttgaacttggtctctgggtagcttcttaattgagaggcaaaccaagatatttgcaaggaaaactcaaaacggaacatggcaacaactcttggacacatgccagattaatagattatcatcattacagcggatagggagcacattactttttttgcacgttggtcttaaggcccgaggccacgccaaagagagtaagaatgtccaaggctaagttgatatccgaggcaactggctttagaaacaacactgcatcatctgcatagagggagagccg

SEQ ID NO: 12437 - DNA, 186 bp, Zea mays
ctacattcatttgaatgtagacggaagaaaatagggctagaaaatatgtctacattttcttgcaattgagcttttaattcatctggttgttttgcatttatttatggttggcttcttgagggcttcacctagttctgaaggcctgaattattgaatggctcaataccataggtaacctgcttgaag

SEQ ID NO: 12438 - DNA, 1500 bp, Zea mays
aattataattattagaatgcaattcatttccaacgaaacaaatggtcaaatggaaaaataggaatcccttagaaaaatgaggttgccaaactaacactaaatatattgttattttggtcgactttatttctcgataattatcagacatattaaattgaatatatataaatatatttgtttatgtttttgcaagtaaaattaacacatattatttatatatcataaaaaattatacaatatagaaggcctatcgcaatgagcttgcatgggggcccttaaaatcataggaccggggctaatcgttgtctacgcctttaagaccacgttgctccaaatttgagacaagcttgacaagtgtgccatctccatgaagaagtatgcaggcattaagtgtgaagaggctttataagtcaaggatcaaccacgaagctcttgatgaaaatgctcacaatcccaagcccataacacatttcagtttattgtctccattttgaccagattagaattaagtatgatagtgaccaatcgagtggatggtgatgctgattttaggccctttgacagtactacacattaacacatatatatgcagtttcctttatgcataaccaggggtagtgcgtagaggtggccttttgttttgcagtcctttattgtatttcatgatgtacattagtaggccttcatgctataggattcacgctagacatgtgggagtggctttttggatgcagtggtatggaaattgtaaggtatcacgatgtaggtttgcatgtgaacacgttttatatggatcattttaagactattactaaatttctgttgaaattgatggtttatttatcgtttgtatgaagcttgtgattcacacatccaatatatttatcacacccttaaaaataactacattccgtttgccacctggctgaggcacctaaagaataatacaaacttatatgttttgagtgttcttttttttgtgtgtaccaaagcacgacagtggactcgttgtctcaaagccaatcattatatgttgatccaacgtactttgagtgcaattacactcagcagctgtgaatctatacaaacttcatagacccaggaatgcaaattgggactttagggcctcacttgaagacaagttcagtgaatttcactctctctctctctctctttttttttttgtctcttgcatccacacacgcatgaaaatgtttcaccgctagtagcattgcagcctccattgttggtagaactagaatggtactagttgggtcgtgagaccaggaaaaaggaagtcagggatactttcgtcaagaccgaccggtgtcgtgtcgcctgctttgaaaaatcatacaacaaccaactaaaataagcgcacgcgcacacgcatcccggcagtcctgtccagtggtgcagctgcctgccttcagccttccctctctttcgcgacccccccggagccggagcagagatcgccagctctaccggcgcggaggc

SEQ ID NO: 12439 - DNA, 801 bp, Zea mays
ctctagaggatccccctgtagaaagctgtcggagataaggttatatccgacggctcctaacgaatccgtcggagataccgtaaccgttggaggttttccatttttgtgttttggtgctctctttcattcattccacgagaacgataacatcacagcaagcttggatgtggatgcatgtgggttagttcaacatgtgcatggcaggaaaggctatacacgaagacgctagatatatatgcgtgtaacacttcgatccatgcatgtattgcatgcccgtgatatatagtcgacgtccgtgtatgaataatatgtgcgcacagccacacaattattcatatacacacagatgcagtgtcttaccaaaaggttatcggaaatactaaacaaggacaagtcctgatatcattacattaaaatataattatggaatattctgcgattatatatatgtatgatgaaatgagctactagctcccacatccgaaacgacccccacggccccaccactaggaattgctaatctttcgcaaaaccatttcctaactcccccacttccccaggccgtatattctcctctttataatcctcccactatcaccaccaccacccccctctttctcgctagacctcaacgataccaccaccgctagcgctagtgctctactgctctgctctttagggagagagagacgggagtgagagagcagagatggcagctgagagctagactgagcacgcacgtaacgtaacaagctcttctcccatctccgtctctggcaagagagagagagagcgcagaag

SEQ ID NO: 12440 - DNA, 1500 bp, Zea mays
tttgttaagctgctaagaattttttgtattacgcttggaatattggaggaagatttgctttgtatagaaagaacaaactggaatgtcataactcataagaataaatctacatcaactaaaattttattgcaaatgcttttcatgaagaatatcggcatgcattgatgtgtgcaactgcaaaacatatgcaagatattgaagctcataaggattctagtcaacgcaattaataaaataatattgtacttccgaaataaagaatactcaccagattgtcttttcttaagtgatttacgatacctttcaatagtctcataaagatttctacagaaagactcagcaaacataagcatatcagaaatatggaaaatcgagatgaagcaagtagactaagtggaaaaatagttaactgattttatgacatggtggcgaaggccctacacttgattcatycgttcggcgcttgcacgcaagcctcgggtcaccggcaaggagggctgcaagccacgcccaaatcacagtcaggccacatggagagagggaggtgtctcgggtcgctaggggcgctcgcccgtgagccctaggtcggggggtgccccaacagcgggagggggggcgtttgagaaagaggggatggtctcctcgcattggttcacgtggatgggagggggatggatctctagcgtgccatggcaggaaagtgcagggagcatagggctcctggccaagaacaacaccctgtcggcagcgtttagatgaaatggatggatgggggaatggcgggcgacagcgtttatcagagaggggaggggtggagcacctgctggaagcttcacaatacatgacggtgcggtagaaggtggaagtgtccagaggcgatgaaaacracggacgcacgagagagcacgcgacgaatgtgagcatccacgaatgaatgactacggacatttccaacgatgtggataggttaggaagccacgttttctaccagcttttatatataggaaatgacagtgctgccctatctcctcggtggtcacctggacgggcgtgcttcccaacctcccagacctacctccccgacgtcatactctcagttaacgtggagttcacagctaagcagctaaaaacttacacctttcaatggtatatatctgaagtaaattcttttaatgatatatatctcaaatttggttcttttgagggcatgaatccaattttctctagttttaaaaattttactttttaaaaaaaaatgtaaaaatgaaaaggctcgcctttcgtgggcctcgtccagcacctcccaagtccaccacgagcccacccagacgagacaagacgggacaaggtgtgtggtgtgttctgttcccgacacccgcccacaccggcgaccaccagaccacccaaatcagttgcccttgcccacacggccacacgcctctcctctccttttctccttcccccttcaggctccccgatccgacgaccccagcggcggcg

SEQ ID NO: 12441 - DNA, 359 bp, Zea mays
tctgtcaaggcaaaggtataaatgtccctgaacattatgttctgatattgtaggttcatataataaaatatgtgaataatgttacttgtttctgatacatctatctttaatgtttcatgttttatatattattttatattactttgtaagtctaatcacgaaggtgcgacctttgtgatattctgctcatggtcttcgtccaaagatcattaaatccttggggagataatgcttcagcggacgaagaacattaatatttaacattttatgttaccttgttcttatttcataacatttgaaaacaagtccccaacattggcgcccacctctggtgaactcacttccactttcctgagaca

SEQ ID NO: 12442 - DNA, 339 bp, Zea mays
attaaaaatttcatcatgaatcactccatgaggttgtctatgttcaatgagcaaagcaatctgaaattccttgccattgctgacacaagattgcctctgctattgtgatgttgaaaagatttattgctataaaagatgctctttcagtgatggtagtgagtgaaaagtggagtgtctatagggaagataatccacgtcaggctcaatttgtaaaggagaagattgtgaatgatctgtggtgggataaagtgcgctatttccttagtttttactaagcctatctatacaatgatacgagcagcagatactgacaagccatgcctccatttgatatattag

SEQ ID NO: 12443 - DNA, 336 bp, Zea mays
ggggcagcaaggctgtttaaccgccaatacctactacccaacggcacgcaagaatgaaccaccaaacctcaccaaaacacgcccagtttcctctccggcatcacctatccaaatcagaaacatccggggaaaaagcgacgagtagaagaccgcttcaccttcccaattggaaccctgccagtcgctgacttgtgggcttcgcttagagcaagcaagcgtccgagcagcagccggttcctttcagaacgcgctcggaaatgttagctgattaggtaaccaagcttcaccaagaaccgccgttttcgtatatatccccggcctttttggcaagcatgg

SEQ ID NO: 12444 - DNA, 83 bp, Zea mays
  unsure (1)..(83): unsure at all n locations
cccccaccccgatccggccacnccgtcanccgccgccgctgtcnccaccacaacacaccccggtctgtcccatcccctccccg

SEQ ID NO: 12445 - DNA, 1500 bp, Zea mays
tgcttcaacatgtgtgtttgacttagagatagagatttgagtttgatttgcaaaaacaaaccaagtggtggcaaaggatgatccatatatgccaaaattgaataaaactcaaagttagtttttatttgaagtgattttgcacttgttctagttgccttatgttgtgttggcataaatcaccaaaaagggggagattgaaagggaaatgtgcctttgggccatttctaagtattttggtgattgagtgcaaacacaagtgcttaaatgtgaaaatatgcccatggatgaacaaagtgcaaatcacaagtaaaggtatgtttctaagccttagtacattagttttgtgtactaatatcttgtctaagtgttagaaacaggaagaagaagaaaagaagtggagagtggctgtgttcagccaagggctgcttcgggctggggcaccggactgtccggtgtgcaccggacagtgtccggtgcgccagatcagcgcagcgcaaaccagccgctctcgggtttttctccggcgacttcggctaaaattcaccggactgtccggtgtgcaccggactgtccggtgagccaacggtcggccgggccaacggtcggccgcgcgatcggcgcgcgacacgtggccgagccaacggtcggaagggagcaccggactgtccggtgtgcaccggactgtccggtgcgccagatctgcaacggtcggcaacggtcggcttcgctttctatggaaacaaatcgggcaccggacagtgtccggtgtgcaccggactgtccggtgcgccacgagacagaaggcaaagatggccttccagatttgttcccaacggctcctagctgccttggggctataaaagggaccccttggcgcatggaggagtacaccaagcattcctacaactcttctaagcaccaagacatcaatctcacgcattcgtttcattgtgatagcatatagagctcttgtggagttgtgaactctttgtgttgcgttgcgagctcttgttgcgacttgtgtgcgtgttgttgctctgattttcgagtcttgtgtgcgttgctcattcccaccttactccgtatttctttgtgaactcaattgtaagggcgagagactccaagttgtggagattcctcgcaaacgggaaaagatcaaaggaaagaaaaacaccgtggtattcaagttgatcattggatcacttgagaggagttgagtgcaactctcgtccgttgggacgccacaacgtggagtaggcaagttttgtacttggccgaaccacgggataaccaccgtgtcaactctgtgattgctttcttgtggttattgtgttttgactcctctctagccacttggccatacttgtgctaacccttaacaagtttttgtggcttaagttttgaagttttacaggatcacctattcaccccccccctctaggtgctctcaattggtatcagagccgttctcttcaagaaagggactaaccgcccgaagag

SEQ ID NO: 12446 - DNA, 1500 bp, Zea mays
ttgtctcttttgtcaaaagttggcttcttgtggggagaagtagtgattatgggaaatagggggagtttttgaaatctttgatcaatctcttttggaatgactctctttatgcttcaacatgtgtgtttgacttagagatagagatttgagtttgatttgcaaaaacaaaccaagtggtggcaaaggatgatccatatatgccaaaaatgaatcaaaatagatttgagttctatttgaagtgattttgcacttgttctagttgctttatgttgtgttggcataaatcaccaaaaagggggagattgaaagggaaatgtgcctttgggccatttctaagtattttggtgattaagtgccaacacaagtgcttaaatgtgaatctatgcccatggatgaacaaagtgcaaatcacaagtaaaggtatgtttctaagccttagtacattggttttgtgtactaatatatttgtctaagtgttagaaacagagagaagaagaaaaggagaatgttggctgtgtacagccaacaggttgtttcggtctggggcaccggactgtccggtggtgcaccagacagtgtccggtgcgccaggctgcctcgacctgaagacgccgctctcgggaatttgccgacggcgtacggctaaaattcaccggactgtccggtgtgcaccggactgtccggtgcgccagatctgcaacggtcggcaacggtcggctgcgcctgttaaggaaagaaatcgggcaccggacagtgtccggtgtgcaccggactgtccggtgcgcccgacgacagaaggcaaggatggccttctggatttgttctcaacggctcctagctgccttggggctataaaagggacccctaggcgcatggaggagaacaccaagcattcctacaacattcctaagcaccaagacatcgattccacgcatttggttcattgtgatagcatctagagctcttgttgagttgtgaactcattgagttgtgttgcgagctcttgttgcgatttgtgtgcgtgttgttgctctgattttgagtcttgtgtgcgttgttagtcccttccttactccgtatttctttgtgaatcttaagtgtaagggcgagaggctccaagttgtggagattcctcgcaaacgggatattgaaaggcaaagcaaaacaccgtggtattcaagttggtctttggaccacttgagaggggttgattgcaaccctcgtccattgggacgccacaacgtggagtaggcaagcgttggtcttggccgaaccacgggataaaccactgtgtcatctctgtgtttgatctcttgtggtattgtgttttgttgagactcctctctagccacttggcaattattgtgctaacacttaacaagtttttgtggctataagtttaagtttttcacaggatcacctattcaccccccccctctaggtgctctcaattggtatcagagccgttctcttcaagaaagggactaaccgcccgaagag

SEQ ID NO: 12447 - DNA, 837 bp, Zea mays
tcggtaccctgtgtacatgctttaacgcagaattattagtatggcgccgcgcggcaaggcaacagatcgagcgcgagcgcatcatctggtagagtcgatttggcgccaagaagtgggcgggagcgttgtgcccgccgttttctccggtatcctctcctctcccgtcccgtcaatccggtctcggcgtctcgcctttcatcatcattacgtctgctaaacaaagcaaaggccccgagctaccgaccaccgtcccgccactcctccagcgccacggggaagatgagcgcgcgagaaaaggctactcctactagtcctactaggagcagtattcccctcccctccccccggcccggccgacatgcgccgcacgttcgtccctcgcttaaattaggcggggccgccgccctccctccttttttagttttcccgcgggccggccgggtccatcgcctcgcctaattcaaccccatctcggccgtcgtgcgcgacatgctctctccatcccgtcccgcccaccgctgctcccttgcctgagctgccgcccgccgccgtcgccgtgggaccgatcggtagtaatcggtccagagcgcggtgcagcgagcgggagcgagggaggcgtcgtcggccgtccttcgtgccccgcgttcgttcttggaattggtccgcgcgcgtcctcatcagtgagtgtactgttccggatgtctctcgctagtcatcgacgtcgtttatctactcccattgagattatgggttcgaaagaaaactgtgtgacactcatggatgctgctgcctgctccgttgtaggaattctatgtaaggcatgtgaatggatcgcca

SEQ ID NO: 12448 - DNA, 892 bp, Zea mays
atcgacctacctcttcaaatatataagaggacgtctagacctgtttctaggcgttctctaacagctcccgcggaattagatgaataaacacacgaggaggtaggccagagttttaatctttgatcttatctaatcgtggaccgtccatgcagtcgttccataaccaataccacaaataatacaacactattcttaaaatctatagtgtaaaatttagaacacgttatcacacctacgttcacatgcatgcacaccagcactgtcggtgagacagtgaatgcactgcgttgccgttgcatgtccggcccgccgagggaagcagtgcaggcgtagtacacggcaccggtgctgtggctctcggctgcctctggccatgtggggcccacaattgcgtgggggcccatccagcggctaaactaggcccctgccatctgccaatgcggtctgctccgggaggggcagctcatgcattgcacaggatcattcatgccactgctcttgttcggcctgccgagcttaaggggccaggggccagcccaaatattctctccatgcatcattgcattttctgcagccaagaattgaccaagttttttaggtctatataaacccccccacccctgcactcactccccactcccaaaacttgcttttccctcttgctctctctgtctgtctcatgctgcatgcgtgctggcttcaggcagcttctatgatcactgactgaacaagaatctgatccgcttcactgaacaaggagaaaaaaaagggagagaacaaggtagagtacaacaaacatattttgatccggtggattactgattggtgatctctgcatcttgcaccttcaattctggcagaggactgagagcaaggacagagggcggtgcag

SEQ ID NO: 12449 - DNA, 482 bp, Zea mays
atcatataatgagaataaaattaatctaatgatttgatatgattattaatgttattcatatgtttcatttgttcttgcttttcattacatattaagatgatgaaggtttgtactttataaccttcatctgaagattattatatcataaaagagataatgcttcgaaggacgaagatttttaaccattaatatttgtattgtcttgttcttagcttatagcatttgagaacaagtgatcaacagatttatgttttcaaacaaccactaacagttggttgatttcaagattaccaggtcgcacaaattcgaaacaacggagtgcaactctaggccgctctaaactcacaccatttgtgcctcactcaggttcaactatttcggttgcataccttgacgcttccccaacgcatgactccattctttcccgggcctccccaaacaatacggcaagaactcccgagaaaggtttctagctcacacca

SEQ ID NO: 12450 - DNA, 1500 bp, Zea mays
cagctggcctggttgagttcctccaacagcccagtgtttggttactcggtcaagtcgatcctggctgcacagagtctatgtttggttgcttgtatgagatgcggattcaaattgcagatgcaagcacatggatgtttggttggctgcatgcatgttgttaaagtcacctcttgcatacatyggtaaggttaccmccacagaccaagaggggataaaacagctaatgtaaccattattacatcaatttggaaactaaaattgtaatgattaaagcttgaactaatattacaacacctcctgcaaatattattacatctttaattgtaatagcactagctttgttcctaagaagtactggaacttcctgttgtttgtcctcattgtcgtgaccattgaaagctgtcatcgcttcttctcttgaattgcatcgtttgtagcaagctcccctgaaaaccgtgcacttaagcatgacaagcatcccaagaagaaaacacaccagtttgatgccccagcatgtactacacatcaagccatagctgtaaattttgttagaacataatacaatgcaaggtatagttacatagaatcattataggcatgaattgtgcttagtaacccactagataattcaatatatagatcacatcgtaataggcaatgggcattaatctcagaccaaggtagcaagaaatgaacatttgcaatcagcttccccgtggggggctacaaatacccagcgagtggcacaaaaggaagacggaaagtcggtaaccttagacttccccrcgcaaccacacctgcattgtgggagccacgttttggagtccgcgctcctccctcgcgttcgtagcgagctaggccaagaagaaacagaaagtcgctgacgttttcccgctaggcttaggagggaggaatgcacatgcrgatataaacctctagatatggtataaacaaccaaactagtgagacctatatttgatgggcctcgctaagctgaatgtaaccaatcgaacgcccatttaaggctatcctcaatagattatccacctctatcattatatttaaactccaccctattaataagtggtctatattaaaaaacaataaaaaataatattttgagtacgtattgacgcagatactacaaaatacgttttcacatagtgggtttatgtgtttcctctcacgaagcgcgatgcaaatggctcgccgttccgtcgccccaaccgaacggacgtgacacgcacgcacggacgcacggcacgcggacacggcgcgcgcgcggcgactccgggctggggtctccctcttcccttccctcagatccaactccgtttctccattccctccctagcccagccaggaaaccagtctcagtgaatcccgcgcccggatcaatctcgcccaaggaagcagctcttcacgacttgcttccagatccatccatccatccatccatccatccgaggttgggccgtgggggtgtcggtgcggtgggaa

SEQ ID NO: 12451 - DNA, 1431 bp, Zea mays
ggttgtaaactctgaaatagcgtttcttctgcttgctctagttctgcagtactacctccgttcacaaagatataacaccgttgtttttttttcgaaaattttgaccactcgtcttattcaaaatatttattaaaaaattataaaaatttaagtcaaacacaagctataaaaaaataaataataactaattatttatgaaccgagagagtagtatttacggtacgccactgaagtaactgcatgattatagcatttgctctagcgtttgtcattgcggctagcgtttatagcatttgctttagttgcattatttttagatgtcccttaaaactaatttttaggagtaattttctggagagctcttagagatactcaaagagaactaccatccagaaaatcactatacatgcttagagacggaacaacaacaatgcagcatgtggccaaaatcttattatcagaatgctgcattctccatgtgactgcattctccatgtgaccatgtataaaattatgaagttttttttttttaaaaaaaaaactcctatatagcttttaccaaaaaagtgtttcaatacaagcatggagaatgtgaattgagcttagataaaaactaaaactgcatgaagtcacgattagttaatatttgattgataatggaggaatatatgcctatgagacactagttcatggaaaggtggtaaccctaacagttgacacacacacaaaaaaaacttttcagcaaaactgaaacgtgtgatggcggccattggccaattcatgtatatggaagcagctgcttatcagcaacatgctctgaaaagaagcaaatcactattgctggctcttttatgaatcaaattacaagtagcagtgacatggaccaagagaaggaagtaaatgtggagcaacaaggaataatccaatccaatgagactgctggacaattggactagtcgattgactaaaccacaggtccaaaatcgctatcttcacaagcgagcaagtttttggacaatcccattgcatgaaattgaaatgggaagactggcaatcaacacaacacgggtaggcaacaaacattagaaatcctaaagcaggccaatgaaatttccagattccaatacaacctatgacccaaacaaaagtagcactagatcagcatgaatacataagccagtgcagatcatagcagagattcgttaccaggcaagccaaaatcagtgacaaaggaggcagacccacactttacattacaggtagctaagcaaaagcaccatcagccagatctactaataattaatcgttgattggttgataatcacacagcaaccattatccgttttatccgaacagtctcggaacgaagaggaggccagattgaattcaaatgagccagccatagaagggaaacaaaatgaaatcacgggg

SEQ ID NO: 12452 - DNA, 1500 bp, Zea mays
ctgagaggcagcctactaatcaatcaataaataacgcaatgccaggccttaacagcgaagcaccagccaccagctatgctgattggcctgtgggcataaagaaagtgtgatgatgcatgccactttggcatataaaggagcctttgatttgggggtcatttccggttcgttttcatcctgtatatatattggacattggttcggtgcgtgccagtgctctacttttagggtctgaactgctgaaatgctactagtagtttgctgtatattattatttggtacgtagtataaacgtacctttatgttttaggtccttcatgacttttttttttctcattcgcgaaccaaataactaaaagttgaaagtaacgttgcgttatttttgtttttattttttgccccaggaatcaagcagcaccttttgtagcgggcatgcatggtcgtgtccgtttcttagttggccagttgagcatacgctgaaagctcgaactggttgagttacataatcagagatgttaggttactgctaggtaacgctacttgtaatacaacagcaccttttctttttttttaaaaaaaaatatattcagaaacgtggacatggcactagtgtcattcctcccttcttggaaggacgacatggtcggccacccggcgagtcggcaacgtcaccgtctctgcgtcgacacgtatggcacggcggggatacgatggcgacgctgaaacgggaggagaggacaggaggccacctgcagatccgcttgtctgataatcatgtcagagcgggtgcatccaagagcataggctttctttcgcccgtctgacaacgcagcaacgcactgtgcacgcgcgcggcgcgccatccctccgcggcgtccagaaacggcaaaggtgccgggctgccgtcgccgggtcggtgcggtgtacaaggacggcgctgcagccatatgcgcatgccaacagtgccccgggcggttaggtgaggcagtcacgtctgggctcgtggtgacttggacgggggagggagagggacgctgtcccggggggcgagcgagaatgtgcaggcacatggggcgtttctcggaaagcggcagcgccggcgagtcccccccacgccgcggggggctccggatcccatagaaaaatccagaatcgtttgcacctggcggcctccaaatggccgggtgctctctccgttcgaccattcctaggctaggcggaatggaagggagacagagagggaggagggtctacggcttgctttaggcgaacgtggactgcggcttttctgagccgctggtgactcgcccggcacggctgctgactccacaaatccactgcctttgccaaaagcccaaaccccccccccaaaggatgttccacttccggcgccggcgccctctataataaatggcgccctcggcagctgcactccggtaccaatccgcgattattccttgcacgctaaggcacggctctagaagtgtagaactagccatg

SEQ ID NO: 12453 - DNA, 1500 bp, Zea mays
ctcctgagaggcagcctactaatcaatcaataaataacgcaatgccaggccttaacagcgaagcaccagccaccagctatgctgattggcctgtgggcataaagaaagtgtgatgatgcatgccactttggcatataaaggagcctttgatttgggggtcatttccggttcgttttcatcctgtatatatattggacattggttcggtgcgtgccagtgctctacttttagggtctgaactgctgaaatgctactagtagtttgctgtatattattatttggtacgtagtataaacgtacctttatgttttaggtccttcatgacttttttttttctcattcgcgaaccaaataactaaaagttgaaagtaacgttgcgttatttttgtttttattttttgccccaggaatcaagcagcaccttttgtagcgggcatgcatggtcgtgtccgtttcttagttggccagttgagcatacgctgaaagctcgaactggttgagttacataatcagagatgttaggttactgctaggtaacgctacttgtaatacaacagcaccttttctttttttttaaaaaaaaatatattcagaaacgtggacatggcactagtgtcattcctcccttcttggaaggacgacatggtcggccacccggcgagtcggcaacgtcaccgtctctgcgtcgacacgtatggcacggcggggatacgatggcgacgctgaaacgggaggagaggacaggaggccacctgcagatccgcttgtctgataatcatgtcagagcgggtgcatccaagagcataggctttctttcgcccgtctgacaacgcagcaacgcactgtgcacgcgcgcggcgcgccatccctccgcggcgtccagaaacggcaaaggtgccgggctgccgtcgccgggtcggtgcggtgtacaaggacggcgctgcagccatatgcgcatgccaacagtgccccgggcggttaggtgaggcagtcacgtctgggctcgtggtgacttggacgggggagggagagggacgctgtcccggggggcgagcgagaatgtgcaggcacatggggcgtttctcggaaagcggcagcgccggcgagtcccccccacgccgcggggggctccggatcccatagaaaaatccagaatcgtttgcacctggcggcctccaaatggccgggtgctctctccgttcgaccattcctaggctaggcggaatggaagggagacagagagggaggagggtctacggcttgctttaggcgaacgtggactgcggcttttctgagccgctggtgactcgcccggcacggctgctgactccacaaatccactgcctttgccaaaagcccaaaccccccccccaaaggatgttccacttccggcgccggcgccctctataataaatggcgccctcggcagctgcactccggtaccaatccgcgattattccttgcacgctaaggcacggctctagaagtgtagaactagcc

SEQ ID NO: 12454 - DNA, 955 bp, Zea mays
cgtatttgatctgactaaaattctttacatctctacccaaatatatatttttttaatcatagcaatcgactaaccgcgttagactgaattgcgaggcaatgtgatttgaccgtggctagagaaatgagcgtgatccaagttaattttgaagggaaaaaatggtagagtttttaaaaataatcttaagaacccaaaaaaaaaaagttctgccagtgcaggaaccggagattctgtaagcatagctccaccatgctggcgtgcaagcgaaggggttgttggttggggaattgcttgtccaactcggtgatctgatcgcccatgtaaacgcctcacaccaactgaaacagaagcggggcggagaaaattgaggccagcgctgaccgttgccacgcgacaagatgctgacttttggagccacccccggcgcgcatccatccgctcggttgcaggccagctggtcagtccaaacccaaggctagcttcttttgctgatctcacgcgagaacggaagcgaactggatacggataacggcgcacagagaaggttctgctaggtgtttcgtttgactgctaagacggaagagatatgtgtctgctttttctctcggtccaaattagtgaggcctaggaccggaatttggctgcaggaattccgaacttgtcatcactttcccacccccttccctgttctcttcctagttcctactagtcgtatcgttctgtgcggtcccttgttacggcttccaaaacaaaacagacatatagtcaacaaaaagaatcacatgaggaaattgttgaataaaactccattgttcagtactaccactactgtattatcgtgtgctacagcagcgcgccatacttgaccgcatcagcatggcatccacggggacgacggcggcggcggcggtggcggtgccggaggtgacccctgcggtcgggcaacggaaagccg

SEQ ID NO: 12455 - DNA, 49 bp, Zea mays
cgtttacaattgaggctcattttctatccttggcccaaagtctcttttc

SEQ ID NO: 12456 - DNA, 316 bp, Zea mays
agttcgccagttcagggtcttctgaatggtagagctagcattttttactctctgttaatgtccacaaactgaatttgtcagacgtgtcagttttgaggcatgtgattgcaaaatttagagtaagtccatgacatgtactgtttttatgattgtgcataatgtgctacacatttatctattggatctcctgttttctatttataactctctcattctcccgagaggccattctttgacagttcttttcttgaaagaccaattcttgaatgatcacaagtgctttgctcgcaacgattctgtagaagcatatgctgtc

SEQ ID NO: 12457 - DNA, 1027 bp, Zea mays
tagtagagatgtaaaactagtagttgaagagttgccatcggtaacgatgacaatcagttaattattttctaatagtgtcatctaaaatgtcatccattctatatttaggaaatattccttctacatacttcaacgatattctgtaaaatattcatatgtggagagagactcttctcttttatatctatttttatatagtttaaataatacattaagtaaactaaaatatagactctctctatttattatttattatcactgtttatttaaaaataaattagtgaacgataaatatttgagaacgaatatagtataatatatttaaagttataaagaaacctaaagtaaatatgtctagtttggaaacttaaaatttaagtttctaaattagccctcgtgcgaatatgtattttaacgagagacgaagaacaacgttgggataaatgaagaggaatttttaggctgtaaagaaggaaatgagaggatagtcacagatgcggtttggtattcaataccgaaattccgtaatcgtccagggcaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggtacgtcttcctccagccccgcgatttcacctccacccccgcttctcctgcggcaatccatcgctcgcgtcgtccctactgggtgacaagagggcgaccacgcccacctccacactcttcgacctgtccccagcctgccgctgcattttctctatcttccgtccggctatttttttgctgaatggtggattgctgatctctatacatttcccgtggatcggagagtccgagtgatacgcgtggggattggggagactcggatcagctccgctcctttcctcggttctgatgtcgtggttggctgttgccctgtgcaggttgttcagc

SEQ ID NO: 12458 - DNA, 1416 bp, Zea mays
atttgtccttgaatagttggtgcttaaagcttgatttggttggtctcattctagcttccacaagttgttgtgtgttatagcaaaactcctcacggagctatacaaagaagctaatcatcctgctcactatggtgtcgaaaagatccacgagtgtagaagccatagaggtgagaattatgaaggcttcaagggttgtccaaattatggtgctaataggtatatgacgaacaaagattataaggagaaagaaaatagagcctctaatgaagacctcctattggtagactttttaaaaaaaatcctagaaaatttgccaagtgcatttggtccctgaataatgaataaagatagttttccttcttttcttgtcatttttcattatatccataagaagagttatgatgcttttaattgtacgactagatttttttgaaatcctagaaaattctcccaagtgtatttgatgcctagaatattgaataaagatcttttttgccttttttcttatcacctctttattatatccacaggaagagtttaaatgcatcaatagcaaggaaatacatgaacaattttcaggaccattttacatacatgacgaatctcttgtatatgtgattttactttggaatgtgaacatcattattactccattagtattacctgttctccaagtatcatacggtgacattcaggttggctatggaaattaaacacatacatacatactaatactagagttgtgacaacatgactctttcgccgaactggctgaggtgcttatatgtactagtagcagattgcatcatcatctacacgtagatatatgttgctacggggcaattatatagcatcatggttcggttccacggatgcctacctgaattacgtcactgccatgggggctctcatgctccaatcttcatggagtccactccacaggatcagaattttcgtcatgaaaaacctgcaggtggtggactcgattcagccataatcagttcgggcacatttatctccttgcgatcatgccttattaagaatctcatgtccagatccatcgatgcctgcacgcatggggcatggcgtgtctgcaagcatgcacactctactgcgcatatctgctgccaaccaaactctcccgcgttgttcttcttcacaagcaacgcatgcagctctcctcagcgcgcctatataaacggccgtgggcatgcagcttactcaccatcaccaggtcagcatccaatccaagcatccagcaaccagcaccaacctgagcagcttgcaacaagagctgcagtatatctataaattctgttctgatcttgttcgctagcttgactgttcgagcccgggttgcaaataacaacctgcactgcagcgtgattagctctgccaatggcatcgtccagcggg

SEQ ID NO: 12459 - DNA, 310 bp, Zea mays
tgcagcctgcacgcacacaaaggatttcgggtatcgctggaaaaaaaagacgaaataaaacgaggagccgatcgatttccctcttcaaataaaaaccccaccttttccccatctccttccgtctgttcgcggggggcgacggatgtcttctcgttgcggctggggcggccgtccagcgaccacggagtcagtcgggagtagtcgtccgactaccgctccagctccaccagccgctccaatctagccgccggcccggccctggcccctgggggagacgaccagtcgacaacgacgacccggccgcctcctc

SEQ ID NO: 12460 - DNA, 544 bp, Zea mays
agaaaagttagtcagcaaaccaaacatattcctaactgacatattcaaatggtggcttgtttttatgggtaatgtgtgcatctgtacgttccgctaggctgcaaggacctgatttgaatggagaacccgatcggccctaggtgagactctgtatcctgatgcttcaccatgtcgatctcacgaagcacgtacagctgcaaaccaccactcaacaagcgatggaaacactcacatcatagtgcttcgccatatcgatcttactaagcacgtacaggtgcagctgcaagactggtcgagtagtacatggtttctattcaccaagtccaagagggattttttttatacggtacaaggacgccatacactcacaccactacacacgtatacacacggcatgtccttacacaccaaattcaataccactgaatgcatattctgtacctatagaaaaatctcaggttattggtgcgtatcaaaaaaaaatatcggcttatattggattttatgactgagataatggtgataatttttttttcttttgaat

SEQ ID NO: 12461 - DNA, 1500 bp, Zea mays
ggtattgtgtcgtaacatgtggctgtcattttacaaaatatgaagtgaattccgcgttttaccgtgtgcaatgtgaaagagtggctaattaagaactcgcgcgtcgcgtgcagtgcaggggtctttgtcgccgaagccgtgtgcaggatgttttttttggaacaattggatctataccattaaaagatccaaactttagatatataccatggaccccacatgtcattgactcatgtggacccacatgtaagtgagatagtaatggtatggatccaaagtggtgatcttttaatggtatggatccaaatttcccttaatattttatcgaataatttgtatgttgttgcaagttatgaacactatactagttgaatttaggagttgtttggttcgtcatatttgttccgtgatcggtttacatcgtcatcgggtcccgttgcatgctgtttgattgggccaacccataacaaatcacaacgtgattggatccggagctaaggaatctggttatcactgttcaacgcgtgttattcgatccgcagccgctcccgttcgttcgtgaggatgtcaaatagcactgtaaccaaacaaatggtgttattcattccactgtaacagatatcatctgcattcaatcccatcacggttaccgcccctccaattcaaccaaacaacaccttaatataacataggcacacttgttaaggctccaccaacctccctatctcccttctatcccatcatctattttaaacctagctaaaacagttttttttttcacaaacatatacgcgctctgctggaccaaaattccgggaatcaaagctcttaagctcttgcctccactatgaaacctgtgggcgagagccgagaggagtaaccgagtaacgctccaattggatggatggtttttcaccaccaccgtccgatttggaagggatatacgacgaatcaatccaggacaaacaaagtcccgtcccgtcctataaatagcaaaccacagcactgagagagagggggtgtccctctccgctccgtcccagaaaacccggtatagcatgaaggaacgtttttttggcgtgttgatctctctcctcctccagtcctcccccgtcctgcaggagtaaagcctgttccaggcgaggtgctttcctctccactcccttcgatccagtaggtttgcagtctatttcctagatcttgtaggcatttgtccacttggactggcaaagtccctagcccccacaacggctgattgctgtgggttttgatctttttttttttttttgcattcgagaaaaccccgtgctttattggaatccgcgtgtttagggctgggtagatcgtcttctcgctgcaggaacatatcgaaatccgtgggattggagggatttgtggggggttttctcttctcttttgtgggaattctgggtttttatctgtgcggattctgttgcaggggacgagaagggaagggttcttggggggagagggaagaag

SEQ ID NO: 12462 - DNA, 1500 bp, Zea mays
taaacaagaagaatgggttaaatttaatttgaacaccgcattggtgcatgactgtatatatgtcacgttatgtttaaagttaagatgtataaatctatgatgaataaatttaaaagtttatgacctagaaaattttaatagtcgtgagcttaattgaaattcttacatagataacatcgtagatgataatgtttgacactgtttatagagtatagtttaaagtagagaatgcgatagcgatggcctcacattgatcagggcgcatgcaagctcgtgatttcatattacttcggatttcgsccagacgagctttcacacagatcgtcctatatatgatggatccacaccatcttcatgccttgacatcgaccgtggaagaaacgtgtggctcttagcaaggtcaagaggtggttgaaaggcacagcgccatgcccccaagagaagaraaaccctccatgccaactgcttgggagttggaattgtcaagcgcatcgcagattgacatttctggctgctgatgctgatcccatatcatgctgacgagtaaacgggtcaatgcaccgcgtaaggaaatgaaggtatttcttgctttctgtacgactgtaagttgaattccaaactcttagcatgtactgtactgtattattttttcattgtttgctctgagaaatagctatagacaccataacttgagagcttaattggtaggatcatgcttcgaactgattattatatagagccctttctatatttactttacaagctacaagttaaaaagagaacccactttttatttgctcccagttcaatcaccatcagaattgctttaccatatgctcctcaatagaatcgcttcatcagcaaaataataagttcaaggataaaacttaaaaccagaaagtagagctctatttatacttgatcattagtgaactagaatcctattctctcccaaccatttatgtttccgtcacttaatgatgacgctacacctagtacgcaacaaggtcatgtcaccggctacctcactggatcatatgtggcaggttcatgaccacgtattcccccatttcaaatcataaggtatattctgattgtttaaaacacttaaatcatttattttattatatttttaaaataaatttacattattttggttttttctaagaaaataaagtaccttataattcggaagagaaagcgagggggtaggaaatacaaatgtactccgtagaatataatttttttaaataaaaaaaaacatgaggtgttttcccccaaacaccgctccacctccttcctcctcgttgcgctccggatccatccccattccccagtcgccgcccaagtcaaaaggagggaagcttcttccactacagtccttgaggccgcccatcaacgactagacgctggtcaagctgcaccaaccctagccccataaccctaggtccctcctccacgcccccttccagagaggcgaggaaggaggcgaaaggaacc

SEQ ID NO: 12463 - DNA, 463 bp, Zea mays
ggttattggagctggattgcctattagctcccctttgtcctatcatgaggaatatgaggataatagtattagtaatggcacaaatgatgattggttaccaattgttatgcccgcaaagaaactaatttctaatgaaaacctgaagcaatactgaggttcttttatacttgttctattcctttatgctcccatcagtagaacaagcaatgagargatatatgcagaaatgttcttgcctagcattggatggtctttgccatcaaggatccagccactgcttgcagccattaatagctgcaagattccagagttcagttacgatctatcttggctaaaccatggttctcacatgggcatgtagatccaggatcagaagaagttacttgaggagtgcttggcgagatacttgaccgaatcagcctggctgttagatgaaagccaggtggtcaccgaagtgaatgtt

SEQ ID NO: 12464 - DNA, 786 bp, Zea mays
ttgtgcctttaaacttttgtagcatagccgttttttgttaccaatgaggcgagctttgagtttggcaaaatttgccgatgtatttgtaaatgcaactgagctggaaagagttgtgatactgtactaatcccgatgcttgtgtttgctttactgcccgttaggaacaaaaggaatgtaaaaaacaaaaatgtaaaaaaaaatcaagagcttgaagtagatatttatttcctccatttcatgaatgaaagtaaaggtctgtttggtttgtggctaaatgtgccacactttgcctaagattatttgttcgaattgaataactaaccttagacagaaaagttaggcaaaatgtgacaactgaggtagtgaaccaaacatgcctgcagtcctcctctagctagtctgcaagcgcggccgcatggatgaaacaaagttgacaaactaataatctgctcatatatagtatcaagtagtgctttatattattagtattaaactaaaccaagttgtgtatacgaccacatgcatggttgatgtcttaattggagacggcttttaacgtctccatctctctatctctctctcgagcttccttctgccttcctcggttggagtatgaggaatacctttctctctctctaccagtatagtactcccagccaaaaacttgactctacaaaaacgaaatcccaaggccttttaaaggagcaagcaagcaagcaaagacgacataggataggaggtggtaaagagagagagagagccagaagcgaacgaggaggattcgag

SEQ ID NO: 12465 - DNA, 336 bp, Zea mays
gtgggagagatacaggggagaagccgagagccgaacgaagagaccgagcccccgccgcccgcggcgtctgttcctttcgtgccgcttcgtggtggcgccgtggcgcccaccaccacctcacctctcagtctctcaccacctatagcaataccacgagtccacgatccatggaatagactagactacaccgctcggccggtgacgacgacggcgacagccgacagtctatccccaactacgctctgcaccagcgccttatccgccgcctggggtttgttctggcgcggtggcagttgataaaggcgggagggattagagcaaggagagggatcggcg

SEQ ID NO: 12466 - DNA, 762 bp, Zea mays
ctttttagtatactcttaataatcggtttttagggtaaaagttttaatatccttttggagttgctctaagtgagttaaaggtattcaagaccttccacggtggactaccccagcgctgtctgagtcaatcgttgttgaagggaacgctaggaattgcagtagtattcaacactttgttggccctcttcgctggagtcgttggctgagctgagacgctagtgagtcacgaaactactgcataggtcgatggagttaaggctttcatcgttgtgatgtttctttgtttaaagcttttcatcatgataatttaaatataatgcaaagtttataaccaagatagcaagaaaaacattataacaaggacgctgaacacatataaggtatattcagaactacatagatgatttgcacatattattagaacaagttcagtaagagaactgaaaccatttcctgctttgaaacaaaagaaacagaagcctttttttttgttgagatattttctccggagttaagaaagcaacacagatatctctgactctgtccaccaaccgtagccgtagcgccaccaagttaggcctggacgatggaccattatatatattttttgaacgtaagatggaccattatattgacccgttgaaatcgacaaaaaaaggctctattattggaagacttgactctgaaaaggaatggcaccatcgcacagacacaccaataatgggagcgaggagtagtagcaattgaactcagcacctccag

SEQ ID NO: 12467 - DNA, 1500 bp, Zea mays
acatttctaactaattttcaatctaacaaacctgatagccaccggtgaggactttgagggtgttggcgacacacgtaccgcgctggtggcacttggcgagaaggttgcagccttgcagccttgcaggggtagaggtgaaaaggaacctccacccccttcctatctgcttcgatatctattaatcctagattcggtagctatcatcatcgtctagaaaaaaaacatacctgtgcattcgggttacccgaaatattttagtcgaataattcggtattaaaagcaactacccaattttttgttttaaaaactattacccgaaatttcgggttcggattttactggatatacccaaaattgacaaaaccaaccattttcaatagagatttcagttttggatatcgtttaaaaatttcaaataatttttaagggaaatttggatccataccattaaaagatcaccactttggatctataccattactatctcacttacatgtgggtccacatgagtcaatgacatgtggggtccatggtatatatctaaagtttggatcttttaatggtatagatccaattgttccttttgtatatgtgccacatcattaatacaaatggcggctctcatgtcaccttatgataattgttcttaggcaagatataaaaaaaatattatagatagataacaaatgacaaaacaaattgttttcaagaaaaatgaccattacaaataatatatggttttcatacaaatagcatgcacatgatttggtaattacagctgcatgtctctccatacagcgcaacaacactgagcatctcgctaataatcgacctaagacgctgtttagactatatatgaactaaattttagtttcacatcagctcttaataagtcttcaaataggaggtttatggtttagctgacctcttgtgaaaatttcagagcacacatacaaataaactaaaacggtttaaagttttaaatcccaactttagacaatgactagaccatatagaccagagaatgatgaaacgacaccctacttcgtgagcttataaaaagttacgaggaaaataaaccacagaggctagaaaattacagccccacttggccactccaccgaggaaccacttacccggaagttgcgtgggctgacgcatccgagcacgtgtccctttgaactctctctcactcaagcgctacgttgtacaacagcagcaaagaaaaacacataaaaaaaaattctcaatatctctatgcgacgatcaccaagataaatagccgggcaccctcccgcctccacccttgcattcagcgcgaccaggacagtgcagtgctccccgaggtccccaaaagacaagcaggcaagcagcaaagacacgcctccctgcttgcactccccacacgcccagtcgcccacacctccaacagacaaagacaatctagcaagcacacacagcatcaggaggaggagatcgagtacgggtttgaagcagaga

SEQ ID NO: 12468 - DNA, 1222 bp, Zea mays
tggtctgtgaatgcctgttcaatcatcatcaaccgttcattgatgcctctaaccttcaagggattgtttctacattgggaccaaaattttccatgtctgtagagcctaacaaaaaactaaaaagttaaacaatgttgaaagcatgaatcaggaaacaacatgcaacaatctggagaatatatacctttaattcagaatccacttttataactgcctttctgaactctttgattgacttgtgtaagggtgacaagctcacacagacattcacagtactctttcagatacccaatgctccattctgataaccaggacaactgtcgtgattctataaatttggacttaccaaaaaatagaaaatgggaaaaaactgaaataggtgaatctataatttgtttgggagctcctaaggagaggtcaagctctgtggcataattgttgtagtggaagggtaggatactctcatctgagagcctaagagcaacaagccctcgcatgcttgcagctgaaaaggaaatataaagttaattctagatgttgccaagtatccaacacaattagtatgatccactttcactaaccaactctgccaaagtacggttaaaggatcgcataggcaatttcaccgcaacaaacttatatgtacgtttcattctacaaagacaacaaaacttttttaacagactatcgctgggatgagaaatgtgatacatttctaactaattttcaatctaacaaacctgatagccaccggtgaggactttgagggtgttggcgacacacgtaccgcgctggtggcacttggcgagaaggttgcagccttgcagccttgcaggggtagaggtgaaaaggaacctccacccccttcctatctgcttcgatatctattaatcctagattcggtagctatcatcatcgtctagaaaaaaaacatacctgtgcattcgggttacccgaaatattttagtcgaataattcggtattaaaagcaactacccaattttttgttttaaaaactattacccgaaatttcgggttcggattttactggatatacccaaaattgacaaaaccaaccattttcaatagagatttcagttttggatatcgtttaaaaatttcaaataatttttaagggaaatttggatccataccattaaaagatcaccactttggatctataccattactatctcacttacatgtgggtccacatgagtca

SEQ ID NO: 12469 - DNA, 1500 bp, Zea mays
cggtatgtttttttaaaaaaaatcagatacataatgaaacgaacgaatacaatattttacgcgtgcgtgggcacgcgtaaggaccggaaaatgtaggagacaagcaagcaaaaaagagtgctatattatactaaaagttttgatatatatatacatacatataggcatacagccggcggcagcgtgtacgtcattgtccgtctgttacgatatgatcagacaaagcagctacagccgggacggcccgggcccgccacggcgactacacgcacacggcggcccaactaataccaatatatataatactacgcctaaataatccgatgcgattaacgcccactgatgatgcatccttctaagttctaatgcttccttaagtacgtagcttgcctgccagcatccagccacagctgaagcctgaagggcagtcgatgtaaaaggcaagaataatgcaggtccaccgagacgacggcggcggcgcggtgacgacgatgcaacagcagcagacgcccgttcccggcgccaaccgcaaggttggtagaggcaaccgaaggcgcccccctcctcctgcttttttttttaaaaaaaaaaacccgccaccacccaaagtatttcttgaaaccaactcctaattattccatcgaattaccaaatgtatgtgcaactaacctcctacagtatatcctaaagtttgtaccgcacttctacaccatactccccgcctactcatagtaggaaacgcattggtgcaactcttggtagctagctgtaggtactaggcaccttgctcttgctttagttgttcctcttcctctttgggcatgcttggattccaaagcttcaccaccctccctcacctccacttcctctctctctctctctctctctctctctctctctctctctctctctctcattcatctcgcctttctttcttaccggccggccggccggcggctgggctctgcaattcacccaacttttctctgttttcactacgatctcagggctccggcgaccgtgcggcctcatcatcagctacaacctaccagctgctaccgtctcggtcgccgcctagctctccgcagcggctagctcatccggccggccgccccttttctcttgccgttgcgcagttgcgcccccttccccgcggcttaggaaccatcgaaaagacgcctcaccatctcctttgtgtccttgctaactaactcccccattaaatcctctccttcctcccgcgctggccgtgtggtctctcagccctccgagttgatccataagctagcgccatcatcgatcgccatatatacatagccaaggacgcacgcgcgcgcgcgcgcaaaccagcgggagcgaacaccaaccggccggaccaattaagaagcaggctagcaagtcgaagaggaaagaagagaaggggggtaccgggggtaccggccggtcatcgatcgagcttggcgaagcagcgaccgccgggtcgtcgtcgtcggtacatgc

SEQ ID NO: 12470 - DNA, 371 bp, Zea mays
ttcgcccttcggcccgatcgatttggggccgcactacaactacgattcatctcggaacagcccaactagcccattcaacattcctgtaagcgcggagtcggcgacgcacggggagaagtcgaacagcggccgcgcgcggggaagttgcccggcggcggcggatctcggaggcagcgacgcgcgggtggaggagctcagtgacagcgccagtgcctatcgagcgagcgaatcgaggagattctccccactgtttctttcctgctgattccgatttcgcgttgaaacaccggggggagaagaattgcgggcgaccataactcggcaagaagcggctccaaaaagggcatctacctttgccgattccggcaccg

SEQ ID NO: 12471 - DNA, 1500 bp, Zea mays
aaaccttggcacggtatgtgccttgcacgcttcacattgttgctcatcctgtataaatgatcttattatgtgttagggtaataacaacagcttacacgtgtttgtgtttccttatctttgcagacactggtttgttttgggtcagccacacgtttcagttgtcgctgtccctactttgttccgggagtattgagagcttgtgttctgttcacgattgattcaggtgttttcctttgttttgcgtgttttttttcttcttctttttatcgctgagccgatatatatgcactggttctcctctgaatatgggtgtccttcaccaggactcaatatgtgtaattcttttctgtttcctggtcatgattgtctgtaaattgtaaacattgggtttgatggatatcgacactggagtgtaaagtgttggcggttaaatacacggccctctttcctggctcagcaatgaaacttctgttctacagttacctagtcaacgtgaatgctgcgagtagtatatgcaagacaacacgctttgcacttgatacacctcactgtgcccctaatctgcagaaagtcggattaaagttcttaaagttacagcatgacagctgcgacaagaactttagccaaattatgtataaaatggagaggtcatgttcaattgaaatccacccaaaccttgaatccagctaatgaaaatctggggtcaaatcagagtccatgtgtttggttgcctgtatttgctggtgcttgcatcgcgggatgcaatgagctggtgtttaattgttatcaatcaggctctacgcgtgcgaggtgtgtgtttggttacctgtgtacagatgtgaagtcagactcgcacgatacttaaagcatcttgggtcaggctctacaggcgcgagcaaattatttgcatatctggagccaggctcctgctaacctggctcatgcagtcgggctgccgggagaagccaaccaatcacacggagtgtgtacgctgtggtcaggatgagtacgttgtcatatgtagtaaagttatactgcagaaatctgaaatctttgactgatagtgttccaacaaggaggttaaattgtgatttcttgtaaccttaataaacacaaatccctttccctttttagtgccatatgttcaaacggagaagtcatggtaagaaatccatgtaaggattaagggaatcttgcaggtcagggatgtgttcgttggttttcatgcctttcttgccttggatgtttcttcagcataagttctcccaacccaagcaaatcaatgtgctttctcccctgcgcgccatctcccatttaattttccagctggcgtccacacaaagaaaactctgccagtaggccaaagttttgtttcatcacgctcccttccttctataaattgttgcccatggacattcagacccagccagtcacagcattcttcttcctccgcacataaaccataacattcttctccaccttgtttctttccaagccacc

SEQ ID NO: 12472 - DNA, 369 bp, Zea mays
tgctatctctcacatgagtcaatgacatgtggagtcaatggtatatatctaaattgcaatcttttaatggtatagatccaattattctataattgattaattactactagtagcgaattccatgaattgaaaccaaccagagagcctttcatcttggctggtccgtgcagaccctccgagctcttgctgatttggaaagccatacccacaaaggaaccagtgatttgcatccgcaagctgattctgccactgtgtttgcttcaaacgatggatcccattcaaatcacaaagttttctgcccgcgtgctgatgaaatttccaaccttttttccaggggccttatacctcagggcaagcaggggcacctcc

SEQ ID NO: 12473 - DNA, 197 bp, Zea mays
tgcagctgcagaaatagggtcatgtcctgctagcttgagagctctggtacggtgtagcaaggtacgggagagagagagagagtagcaaactagctagggcacagggcagggcaggggccggctgcattatattgggatcggatctgggggcgaccgagctagcatcagctgagagaagagagagggggcaatatata

SEQ ID NO: 12474 - DNA, 1500 bp, Zea mays
tatttgctgacggtgagtatgtgtctgtgtccgagggtgtcgggatctgttatataactcacaaaagaaacatgaactaagtcagaaaaaaatttagaagagacttaattaaaccgccacaatatataagctcttctacgttatactattatactattatactatgtacattttaaaatttactgaaattttatggactcgggaccgatagggtgctcgagcacagctagctccaagcccccaattaacactgcttccatcactgaaaataaatgtatacgcctttctaggtgtctgctttgtcgtgtaatttgacaaaaaaaaatcaacatcgtcagtctctactatatacatataaattgccgttcgtcacgtaaaattgtacacaagtagggattcaaatctttgttgttagcttgacattcacatccatctaaccaacaaactgttgaagtagattataggagtgtttgacttgcacataggctctagcttctataatacaactgatttgtgtgagtttacttagttacttttttgatgttttgcacgacagcagtggcatagtttgtaatttttgtgtaactttatgaggatgtatgaaaactgtgtttttgaagaaccctatgagaaacttcaaagttttcatgaaaatgatctctagtttcaatttttttcaagttagagctcgtaaagctagatctgttgtctagtggtgtattaaagggtagtattatcctgttagatgctgagccatggcatgaaacaaattcaatgacgaggaactaggggttggagaacttgatcattcaccactggatgcatcggaaggtgcaacattgcagggtcaaacaatttgaaccccctgatctttggccacttgtgcgtgccgcgataacacggattgtttttttaccaccaatcggcgtagcaaattcaatgaacgcctcgagggagtagtgttcacgtcgaagtaaccaaaagagaacacatctcaaaacctgggtcacccaatggcagctcatcttttcatacggatcgtgagatctcaatgtggctgcacacagtccgacctgtatgggcgcaagagctcgatcagctctctctgagttcatgtacggaccaatggatgtacatttgcatgcctcgtaatcctgcttgaactgggttctttacactaccaataatagtagtattatacgtatgctctcccaagataaccaacatactgtaatgatggtgggattataagttaagttactgatgtgcttagaggagacactttgtgctgtgcacacttcactttgttctacattttgtaaaataatatatccccaagttgtttaacatgtccatctagctagcttaccttcttagcttgcgctctataaaaatcagtgccacccagccatgccgaacagccagcaaggggcaggcaggaagagcagagttgtcacttatcaccaacgaactgcatagcctagaaacttgaggggatag

SEQ ID NO: 12475 - DNA, 524 bp, Zea mays
gtccctgatttatgagtcaattgatacctagaactgtctcattgcagatggcggctacatgtcctaattaggaagcaaatctttattatccttgatatttatattgcttgtagctgatgtaagatgttgatgggtggaacatgtttgattgtttctcttggattaagttgaaaaaaaaaacaacctgttgtttgggtggatgccatggtcagagtaactgccagtaacaaatttctgtcatcacgtcagtgtcattctatcatgtgcatttctctaacacgatgtatgggtactagactactagttcataaaataatagttgcgataattactgataaaatattattcatatgcatgttgtaaaagagccagaatgattactgatgtagtagtaattctttttaatagttgcgatactgcacaggttccttgtaaactattgattgggaaacactctgaagaagagtttgttggctgcataacatctcctgaagctggtttgaagtttgctgataggaaagatc

SEQ ID NO: 12476 - DNA, 1051 bp, Zea mays
ctgatcgagaagcgctcactcactcgctgtgtgtgtgtgtgtttttttttaaaattattatttgctgctctgactcgctgctttttaggagagggaagaggctttcagcttgctgctggtcctcctaaagtgtgagcaattattggttgggattggcgtccactagaggcaggctttgtccttgttccccatgaagatcgcaggattagcagttgcacacttgcactgtttgctgctgctgcttctgcttgcaagctgatctgcagttctgctgcactgtcctttatgccttcactagctagcgtcttcagttcacaattcacagcaggggctgtgacttcatgactgaccgactcgctgtgtgagtgagtgatgtgatcatatactgactactactgatatcaggtttcagcagacaatcaatactgaaatactgaccgacggccggccatgtattgaatcaatactgtgctgctggatgcaatagtagataccgatatacttgcattgcatgatggtgtctgtactcttctcattgaccactgactgcttcatgtcaaccctaaacagagacactgatttatgtcaatctcttgacatcgattagtgagtactgatcatatatatgtgaaaggaaaagcatggtttacttttagtgtagtgcactgtgctgaagttacctgtaccaatcagtttagttttgattggcaaatgactgaatgagcactgagcagcagctgggggcagccgggcaggagggcatatatccccaacggcaaaagccatgcatctctcctttatttcgtcgccattcaccagttcggcaacagattcccactccactcatatactctctctcccttcctgatagctcctcctcaccattccatcacaccccattccgtttcgcgcttgcaacaaaggttcctttcaacaacaaagctagctttgcaggcacaagaaagaaaaggcttgctcatacaatacagtacatcttcttctgagttctatctcctacctgctgggtcagctgttgggtgggtacggtact

SEQ ID NO: 12477 - DNA, 1500 bp, Zea mays
agctagtagtagacggcttttgaatttcagattccagctcgatgtgtgtgcccagctgccatactctcatgccctcatgcattattatagtattaattactattgccatactccttactatactaatagtaatatatcagtacgcccggccgcagcatggatcggaggacggcaagcttggcaaacagtcagcattatcatgtcatggcttttgactttctgtgttctggcggacctgcctgcctgtccgtttcccggtggtcaggtcagatcagatcagaccattgttttttaacagccagaaccagacagaactgctttcttcttcggccggccccgcaattaatagctttcatgcatgcccggctccccatcagcttggccaaatgcatgtcagcgcgcgagttcaatttctactcaatcccacattcccacccttctaccttcgccggttgcaactctttatttacatggcaaaaaaagaaagaagaaaccttcctccttcctattcagtcagtggtggtctcatcatgcatttgtgcaacccatccagttctggcgttgagattccgactcagaaaaactatgaggcccaaaaaaaacaaaaattaaatgacgacggcggcccattcaaatttaaacgggccggcccattccagaatacgaagcccacctgaaccccgctccccacgggcccaccaaccccgctttcgccgctcccatttcaaaatggaccgctccgcttcctttcctttcttaccaaagcaaaccagcagagccagcagagggccagggcagctagtagctgttaatcgcaattagtgcgcgctaatcaaatgctcatctgtcctcccgaccgttgctaccccatatcccccccacaccgccggctccactccactccgatcgactcgcctgagattctcgcaggtttgcrctccacccttcctcctcctcttccactcgatccggcaatccagttatctccggggtttagtttcggtacgagttgctgcggagaggtttcggattccgcgtcaggtttcgggcgatcgacgcgctgcggcgtgcaggaccggaagggcgtccgtgggtcggcggcgcctccggggtcgacagggagagtgcggatttccgttggttattgattcagggtcttgggtttcgggccgattcggtgcccctgggatcgaggattggagtgctgttgcctttttcgggtgctctggtggccttgcgtgtagcctgttcgactgatttttaggttgggagttcagttccttgccaccaaggacacaagctgttaatatttttgtttacttccgtgatagattcgtgaacaaaggatctgctattcagctaaatgcaaattactacctaatgtgtctcatgcttcattctgctgactcctgactggcttcaatatgcaacccatgcagggactagtttgtggcggaatctcaaacccaggaacctgtgaatcctcgacacttgtgaaac

SEQ ID NO: 12478 - DNA, 1500 bp, Zea mays
ccgaaacagcactagcgttttaatgcgctcccggggccggccacgatgttcctttccgtgtgctcgtgatgatgcacaaaagaaaaaaatgtaaaatgaaataattgtcttcttgacccgatggttgtcagttgtaccagcgaaacgagacattattatcagcccccgtttgtgtcgttccgtgtcgtcatttcccttcgacaattagtccgacaaccaaatagacccaaacagccatgtattacattagcatgaccacacatagaaatctagcaaggttagggcatatatgttattatatgaagaatgtgagtttgccagaccaaaactgactggccacaagtatataaaaacaacaacaagtagaagaaagcttgaaatgaatatttgtggcagtgaagaagccatgaactgcaatccatgcatatgtgtggtacaaatcaagggatgatcatgacaatgtggcaatgcatattggcaaccagccagccatccatccaggatgacggggaatcttcatcgtcctcaacgaagaagaagcttttgtcttctttttttctcttggaaaggggaacgtctcgtttattctctccacgggcgtgcaaaacacagaaagcagcggcagcgctagctagattctccactactacttggtcacgggaaacggaaagccttgtgtttctttcacgagatgccaacaaaaaaaaaacgacattgttttttccagttccttttgataatgcacagaaaggataaatggacgtgtaaacctgcacgcataatgttcatgcagcatcgtactcatccatccatccaattcatccatccacatgtttcccgccgtctctgcatgaggcgaacaccaagcaagaaaagaaaccctctccagccacgtaaaaaaaagcgtgggaaaaaaaagtgagcgaagcgtccagctctagaaaagaaaaaaaaaacgagaggattgtacagagcgcccctcttctaaatttggcacggagctctcgtcgccttcccgtctttcagaattcagagggccgcacacgttccctgccgctgcctctacccctctccgggctctccctccccctctccaccgtctctacaccgccgccgctcacaccccaattcctctcgccccattgccggccgcctccctccgtcctctcgcctcgcttgctgcaggttcaatcgccgccgccatttctgcagtttttaattcccacgtcctgttccggcccggccgtgcactccaaattcttccaacaaggccagcccacgccacccggccgggatcccagaaaagttgcgctcggccttcgcgcgttacgtctcccacccagcccttcgatcccgtgatttcagaggcgcccctgtaccgaaagcctagctcccaatcttccttggattcgtcttttttttggatcttggggactgcactgcacacagtttgcctctcttacctttttttggatcttggtggtgccgagccgacaagca

SEQ ID NO: 12479 - DNA, 456 bp, Zea mays
ggtgcagctgccgttttaattgcaccttccaaagtcagaacatgctacgcagtgaaacttgattttagttgtacaaataatattgctgaatacgaagctttgcttttgggtcttcggaagttgaaggcaatggggataagaagggcggttctcaaaactgattcccaagttatttctggccatgttgacaaaagttgcaaagcaagagatccgaagcttgagaaatatttggatacagtttgaagacttaaagcttccttcgaagggttttctgtcaagaatattccacgaggagaaaatgaacacgctgatctactagccaagtcagcgacacaggggctgccattaccttcggaagtattctttgaaacaataaaagcaccttcagttgaccttcttgaaagagcagtgctcaatatatctcctgtttatagcgaagattggagaactgagatc

SEQ ID NO: 12480 - DNA, 1500 bp, Zea mays
aaatgttaaaaacaaagaaacaatccatgcatatcttgtaagtatttatattggctcaaattccaagcaatctttgcacttacattatgcaaactagttcaattatgcatttctatacttgctttggtttgtgttggcatcaatcaccaaaaagggggagattgaaagggaattaggcttacacctattttcctaattaattttggtggttgaattgcccaacacaaataactggactaactagtttgctctagtgtataagttatacaggtgccaaaggttcacacttagccaataaaaagaccaagtattgggttcaacaaaagagcaaagggacaaccgaaggcacctctggtctagcgcaccggacagtgtccggtgcaccactggacagtgtccggtgcaccagaggactccaactcaaactcgtcaccttcgggaaaatccagaggcgctccgctataattcaccggactgtccggtgtacaccggacagtgtccggtgctctagggaagagcggcctctggaactcggcagcctcgggaattcgcaacggatgctccgctataattcaccggacatgtccggtgtacaccggactgtccggtgtaactgcggggcaacgactacttcggcgccaacggctacctgcaagcgcattaattgcgcgccagcgcgcgcagaaggcaggcacgcccatgctggcgcaccggacactctacagtacatgtccggtgcgccaccggacatccaggcgggcccagaagacagagcttcaacggtcggaacccaacagttttggtgacgtggctggcgctccggtgcaccatacgacggtcagccccaccaaacggctagtttggtggttgcggctataaataaccccaaccacccaccattcattgcatccaagttttccacttctcaaccacttacaagagctaggcattcaattctagacacacccaagtgatcaaatcctctccaattccacacaaggctttagtgattagcgagagagatttgccgtgttcttttgagctcttgcgcttggattgcttcttttctttctcacttgttcttgtgatcaaaactcaattgtaaccaaggcaagaggcaccaattgtgtggtggcccttgcggggaagttttgttcccgtttgattgagaagaagaagctcactcggtccgagggaccgtttgagagagggaaagggttgaaagagacccggtctttgtgaccacctcaacggggagtaggtttgcaagaaccgaacctcggtaaaacaaatccttgtgtctcaccgcttcattcgcttgcgatttgttttgcgccctctctcttggactcattattatttctaacgctaacccggcttgtagttatgattatttttgagaatttcagtttcgccctattcacccccccccccccctctaggcgactatcaattggtatcggagcccggtgcttcattagagcctaaccgctcgaagtg

SEQ ID NO: 12481 - DNA, 713 bp, Zea mays
tagcctatgtgttgattttgggtagaattttaatgcatcaacctaccactttaaactatataaaactcattcaaccaaatcactcacatgcacataacctacactatctaccaaataaattgtatccagacttaatacaccatcaaaatcaatagtttagatcgctggatagcttctctcaattactcaaatccaatagacaattatcatttgtatcatttctcacccctctctcttctctctcccgtgtcatgttgccttttttcacttactcgcgtcgctaccatcatcaatctatcccctcatgtcattgatatctcttaactcattatttcttcgaaatcgtagcgttattacgacccagacgctaccgcctaccgtagagtaagaaaactttagagagtagcacgttgccatctatcttcgacaacccactttccccgcaccttttcccaccgccagtcctccacccacgcgtccgcgcgcacacggaccccaacccaaaccggcaaaccccagctccaagcgaagcacagctcccaaagttccaagtcggacactgtaggcgcggcgcccgcggacacccatactgcgctcaccgagacaccgacccgcgatcccgacggcagctcccctccccctctccaggtctccactgtacgtctgaactgcatatcgcgcacgccgctccggtgctcccctcggcgagcgag

SEQ ID NO: 12482 - DNA, 1500 bp, Zea mays
tcacggattagaggcctggaacgattcctagctaaattatttctctaatttatataagttttgatgagccgaaacgaatcgtagtccattcctagataaacggaccgactctaaagagagactgagagtattttttttactaaaatcacaatttctgtaaattgtgaataatataaacagtcatctgaagttattccaaatatgtaaaatatagaagagtataaaaaaaggaacctattgttttagcttttctacatacctagcttaccaaaacaatttttttactggaaaaataacttatcatttttgttgttttccatttgtagtgcgcgagtagccaagtataccaacatgctcacataatacaacacgtgcatgagttttatttccaaaaaaaaattgcacgcgtgcttttattaattttgtgaggatgtcggtcagggaggatctatgtaatacgatgtatatcaagtgttaagtgtagacaaaaggaatatttttatataagaatattataaaaatagttataaaagccgcgtgcagtcgtgcagatgggaaattgtcgcgtgcagacgtgacgcgaggagcgcggcgtggaccccagccgccacctggcgaacgacggccacgcaactcttgcgaccacacgggcatttggtctcctccattcgttgagtgcgcgcgcggcgcggcgcggcggcttgccattacccgtcctctctcttaccccgtcgtcctcttcacctgcaattgagcatttgcttgctccccctccccgacaaaaaccccctgtcccgtcgagcctcgcatccctagttccctacaagcaaggaaggaaacccgggcaacacgacaccggcggtgccagtgccacggaaaattagccggctccctccccgacgtccggcggcggccgagcaacggttcgctccttcacccgctcttctactccgccccccgccgtccagtgatcgtcgaccgtcccgtccgtttctaagtctcagctcttccattgtggctgttggttaaaagttcgtgggcgcccaggataccgcctgtcttgtcctcagggggattgtttttactgctctcattaatatggacctcatgtttattctatctaccccgcttttacattttgtgggtcttcgttgcgtcaaggagcagaaattttctgggagggaaaaaaaacttcgtcgatcaaccgatctctgtgtttttattagttggccatggaaatccttacttgaaacttaaacttatatccctttccgtggcccgtaaactgttagtattgtctgtcggtgagctcaaatgcttcattctgaaagagagatttgatgtatactgatcagcaatctctaaattcaatttggtgacaccgtatgagtcatttgggctccaaaaacctatcagatgttgtctactccacaagttcacgacaggatgcttcgttctgacagaatgacttctctggatctgcaggtgctggctcccaac

SEQ ID NO: 12483 - DNA, 946 bp, Zea mays
ctttagaaacatacttagaaatcttcacaaaaaagttgaaactatacccattcataatgcatctatgcatatacattgtcacaaaatttaagattcaaaatcaatctagaaaaaatcatatgaaaataacacagtttaggtgcatatgtattagaaggtaaattcttataaattttgtcctatagtgtgtatacgcatcttaacttctgttatttttaaggaaaaattctcaaaatgaatttaaatcttaaattttctgataatatgcatatgtagatatattatggacctgcatagtctcatgaaaaaaagggttagtttggaaactcaaattctcttcggattcaaagcgaaaaaataactggtagttaattttttcctcaattcccaccaatataaggggattgagttttcaaagtcgtagccctaagaatctgctcggttatgagtggattgaatgagattttatccgttcctaggtagaattgaatagaagagaattttatctccctcaaacatttctcgtttatcaagaaatacacgggaatcgttctatctgatcaaatcttatataaattagacaattaatttagctagacaataaatctgtaaaaaacatatagactctcaatcccatacaatcgaataaggctttttttttacgyttcaggagagttcgaacctagtacttcccaaacagaaatgtgtcggtccgcgtcatactatagtatcgggataaagaaatactagcggtcgaaaaaatagcgagcgttgtagcgccgacgtggcccgctttccattcacaggcatatagcatagccccaccaaccggaagccgatagatgcccgaccaatctaatagcgccgcaacgcgaagcgcgaagccgcgaagcctcgcctgtctggtcagttccttcgcgcaccggcaccgcggcggcagttcagc

SEQ ID NO: 12484 - DNA, 937 bp, Zea mays
agtagctaggctgctgggcgagaggaggaagggagcaagaggcggcagggcagcccgatcacaggcgatcgagagcctgtgagcttggtgtgatcgactagtttagtcgtcggcgtgatggcaacgacgcggccaatggaacgcggtggcgtgcgtgcgcgcgcggcctgtccctctctagacaggggctggctgggaattcgctcccgatcccaatccctcgccaattctctcctgccagccggactgccagagccagagccagagccagcgccagctcacggggtactagtatgccggtggcggtcacgtattttaccggtgccgcggtgcgtgcgagcaagtggtggtgcttgttacggcgcgggggcgttgcggtgcgcgcggcgtgctggatcacgatccacgaggccacacaagacgccgttgctgattggattccgcgggcgctacctgctgtttcgttcgctgattcgctgctcaagactcaagggacctgtatggactgaatgcgtagaaaactacgttcaggtgcaagtgcaacgtcggaatgggccgggtgtgctaatataagtagagcttttctgttcatgtaagtgcatctggaaccaaacaccgtgtcttaattgttttttttttcagcgatcgatggataaccttcagtagttcagtcaactgaggtagtgaggttgaagagcccaggtcgtcagtctcggttaaatctttttagtcattgttcggttattctaatttcatgtggattgaagagtactgaaatggagtgaaaatgattttgacttaatatgaatttaaatcaactcaataccacccggtcaccagtttcgacggactcaatgagtcacagttatatctgttcaaccttcagcgtcgatcatggcctcatgcatgttaccgccagcactgctccgtgctcacc

SEQ ID NO: 12485 - DNA, 663 bp, Zea mays
tggctccctaaccaaaagcactcttatgactagtttgagagtccaaatatcggagggggttggagggattttaacccctacaacccttccgattttgtgactcccaaactataacggatttttatttttcaaaagaacataaactaattttcccgttccacggtaaaaatgaaactctacttagaaaaatagttcctctcgttcttcacttcgacaggagctggagcgcccgccctccagcccaggtccgcgccgccgccgcgccgaccacaatcccagcgcccgctgcccagacccagcgccgcctgcggttgtgagcgcgaacaggagagagcgggtcttcggggcgagcgccacgcgcagacggcggttgaggagcctgagaaaaccctggtcttccttcaagatcctggtggatcgcgcccagctccgcgaaatttccttgatgtctatgtaggttcgtcctaaagattcgattttgttggctcttttgatccgacgcagatccgtacggttctcgcctgattctgcaattcaggcgccaggaggcttgctggctgtttttggattggtgtcttctcccatggggtcttgcaggtgtaggagggtgaattctgtctgattaatcagcggagggcaagcggctactgtggctgcgcgaac

SEQ ID NO: 12486 - DNA, 530 bp, Zea mays
cctggacacacaacaatgccactgcaacaaacctttccacgttcttcaaatcagaaattgcttcttcatcaccctccaccagaaaatcaattctgccacacctataacagtcgtttgcccagtcagtcagtattttttgatcctcatctgtggcctccaattcaacattccgccgacaacaaacaagctccaacaggatgaccccaaagctgtaaacatccaccttggcagtgataccgatgttcttaaaccactcaggagcaacatatcctcgtgtaccccgaatacctgtatttgtttgtgtctggttggttcggagcagtttggctaagccgaagtcagagatctttgctgtgaagttgccatcgagaaggatgttctgggactttatgtcacagtggataatctgtgtgctgcattcctcatgtaagtatagcagcccccttgccaccccaagagcaagctgggctcgaatattccactgaagcttggcatcaccaaatagaaatctgttgagtgacccattggtc

SEQ ID NO: 12487 - DNA, 109 bp, Zea mays
ggtcgccgccgtcttcgtcgcgccgcccgagacgctcgaggccgcggccgtggcccttgaggtctaggagtcggacgcgcccaagccgagggccccaaggctagaggag

SEQ ID NO: 12488 - DNA, 55 bp, Zea mays
gtaagccgttgctaagattgtgcagccgtggtatcagcacgagctttatttaacg

SEQ ID NO: 12489 - DNA, 1500 bp, Zea mays
tccaattattttgttattttatttatgttcatgtcaagatcattaatgttaattggaacatggagcttaacttgagaaacacgtgccaccagaagggaggaatgggagcccttggctaactaattagcaaagctagtggaagactaccttacccgaaaggggcaagggcagtaggggagttgcgtgcagggaggttctcgggttgattttgctgcgatggcggtcagacgagtgattcttgcaagtgctcttcccataaactgtagcgggttttcggaagctagtgaaactttgtaaaggcctcgtagtgttgccctgcctcgcttccttggtagaggtgtatgggtgtagcgatcacttggcagatgggtaacatgatttgtgggtacatggtacaacctctgtagagtgtaaaactggtatactagccgagctcacgttcatgagcagctcaggactctcgcatgattaaattatggaactaaattcaatttgtcatttgcgttgcatgggattatttattaattttgttatattcttattatggtttggtatctacttacatttagtaactgctaataaaatttgaccatcttattaaaagcaatgctcagctttaacctctattgttgatcagccttacacatcatatgaactcccacctttggtgagttcatacaaattattccccacaacttgttgagcgatgaacatgtatgagctcacctttgctgtctcagaccccctacaggagaagaacgggtggttcaaaaggagccacacaacgaggagttcgacttgatctaggtggcgtctcccagtcgactttatggtgtcaaggatggactttagttcgttttatatttatcatttattttgtaagacttccgctatgtaataagtactctgatgatattgtgacatttatctctatatactctgttattatatgtgttgtcttctttggcgcatatatgagatgcacccggctttatccttaaatccggtgtgacaaattggtcttatatctttttgattgataagttttgtaatggttatatagaagactttaaacaattagcataacttgttacgttgaaaaaccaatatatcaataaatttaatattatatagatatatataaacatcttatatatactattctttattatgccacgtgtatacttccactggtaacgagaaaatgatggagttgcacagaagtgtggcccattatttttgctacgaactcgaagagaacttatcggcccgtgctcctgcgcaggcccagcccatggaaacacgcggacaccttagcgggcccacattgcaggcgccgttgtccggggtactaggtaggtctttctccttgcaatctttccgtttcttcgtttgattccctcccgccgccgccgctggagacgcccaaccacgacagcgccccagggttcgtcctcccgctggaatagtaagtgaccggagaaaagcagcacaagagag

SEQ ID NO: 12490 - DNA, 1041 bp, Zea mays
aggggggcggcatgcatgcgtacagcaaaaaccatgacctcacctttttcctttcggcgtggttctttttaataaaaaatggtgcgcagaatggcttctagtacatgccagtgccacaggtgctaaaggaggtgttttttaaaatcaaagaaatcctttgggcgccgctcatcgcatttataatctatatatattgagaagtcagagggtggggatctgtttcagagacgtcgtaccactactccgtacagatcatagatgagtcatcgatcgtatataggtgcagtcatgccgtgcgtttgtgcggcggccgctgaaaggcaacaagaccaagatgcgttctacctcgtccgaccgaccagcagctgcagacatgtgtacacaggtcaaaagagatcgatctgtgttgttcttcgcctgcatgcatatgcacaatctcaccgtacgtacgtgttgcggccttgcatgccctgccactgcacaaggacaaggacaatcgtcctcgtcgacaggagacgccacagacctgaatcagaagacaggtcgcagccagctcaaacgacccggcatgcgtgcatgcctaggcatggctgccttcgagtttgcgcagttgggcacatgaacagggcaagagcaaccacccacgcggcgtggtggcgagaaacaagcaaggcagcagcagcaagcggaactgcgacacgaaagagagctctaggctctcgcaccgaccgatcgacgtcgtcgcgagccaagattccgcacaaaaaggccggcggccacggcacacgcacacgcttttggctgccgtgttgcggtgccccgttatcccgaagccgctgccggccggttgatctcctcctcccctccgcagctccgcttatataagccctccgtgcccgcgcctcaatggagacatgcaccacgcacgcgcggcaccacatctagtagagcctgcctaccgccccactgtcgtcgtcattaattcaccaggctagagctagctagctggctctaccgccgttccccgatcgagcgtccgtc

SEQ ID NO: 12491 - DNA, 463 bp, Zea mays
cctgtcattgacgacattgattcaattattacagggtagggattgaaattcaatagagcgcatacatgattgcttataaaagcaagtttcagtataactatctcaaattttatgttcatgcaaagggtgctatagtaactcttgcttctgaatttgtatccatgcaaagaggctgcaacatatacataactacataaggcaagggtgttagttggaactcgacggtgcagtgagtcagtgattggcttcatcagttcaatcttctccatctcatccaagaaaaatkgctaaataaaagaactgaagaagtcacagagcgagctcagcgaaagggcctctagcctagtggttgaggactyccgagtagcacctccaagtcctgggttcgattcccctcgggagcgaattttcaggcttggttaaaaaaatcccctcgctgtgccccatccgctctcgggttacg

SEQ ID NO: 12492 - DNA, 978 bp, Zea mays
tgcaggacccgtaaaatgcatggtagaaaccctgatccacacactaggatcaacggagtacatgtggaaataatcctcgcatcgtttctgccatagcttaggattatccccatcaaacccgggaaactgcaccttgggcaattgacctaatgatcgagcagactgccaaccctgatgcccatccccgccatcagtcacggcgacttctcctgtgctgctgacacgaacatagggttcgtcagtcgctatggcatgagactctaccagggtgccggaggaatcgcccctctaggagattcttatttctttggtgttcttcctattacattctacaacgcttatatagaggtatgcacccctgactcaattggaaagccaactaaccaatgtaaacaaactaggaaacaacaaattgactcagaataggaagcaacaaaccgactcctaaacaaactatttaaggatatctctgtttttaaacttatctgattgccaattgttaatccttctcagtttgtctgccctgcctgattgcgtcttctttggtattggcggccatagaaagagtctgtaacacaagttcagcagaagaaaaatatctgtagatagatcaaagagaaaggatggatgatattatctcgattagtgcgaaagatcattccctttcattgtcatgcccacatggctgaagtagttgacaggtataacatgattacccgtacctcaatctcaataattccaccagcaataactcaggcagatttcatcctggaagaacccaacatgtttgtgacagtatctagtgttagataaacttgaattaatcttaggtcttggtcaatttgaggctacaatttcgttttcttttgcttcctttcctctatgaattggttttttgctctatgaagtaataatcacagcaagcttttttggagtatgaatatcatcagctatttgcatttggttgttgcctaggtt

SEQ ID NO: 12493 - DNA, 1123 bp, Zea mays
gttaaaaatttcggggtttctgaaaaaataagaacccgaaattttccaaaaatattttagaaaccggacccctaatagactcacaatttcggttcggtctattcggtccaccgaatagacccgaattatagagagactagtatattttgttaaaatatagacaatgaataattaattgaaagtactattactacaacaagtgactataaaaattagtatacaaagatatgtatactatcgtttagatgatatcattatttctagctaataagttcataaatcatataataataccatcacatattaagagcttttttatatttcaggttattaagtctattcgggttttataggttaggaaccgaacccgaacccataacccgaaatatagcacatataggaatcgaacccgaacccgaaaacccgaatagaccaataattcggtctgttcgggttcggttcgggttcggattcggttttcggttttaaaatgcccacccctaccactgcgggcagcctcacgcgctgaccttttttcgctcgttggcttcgagaaaggcgtgctattgattacgggtctttttatttgtggctcgtttgagtacgtctaaaaacaataaggcccactttgtaatgcgttggatttctcatgtttttttttacttttcctataaaaataaaccgatttctgtgtaattcataaaaaatcttacgttccaacggaacagtaaaaatcctgcagaaagtcaaataatcctaaaaatttaactagattatctaaaatagtatagtactaggtgartgcccgtgcgttgcgacgggagtaaaaaatttgtataaaatatataaacgaaacgacaaatatcactatgatatgtaaaatccgtgtgataaacattatcaatattacacaaattatttctaaagagtcaatttagaattttgtaatgacagtcaaatatgtcgacaaccataaactaatctaatcctttttaccacgacatagcgacgacaagcacgacaggaagaagatcactacgcgggcgaactcgatacggagcaatgtacgaaggagaagcggcactcgatacagcttcggacgtcaggcgcacacggctcgagc

SEQ ID NO: 12494 - DNA, 220 bp, Zea mays
gtgatcaaaccagttcacattgaactatgtatagtcgtaggatgtacatattaagtgatccagttcctgtgtactgacaggagcatgaacttttgtagagtcttggtaattcctagggtccatcgggaacctgccttgttgcactctttgattgtaattatactccttttcgctatccaaataggttagttatgtagttgaatgatctttaatctgaggt

SEQ ID NO: 12495 - DNA, 349 bp, Zea mays
cagaaccaaaagtcactggtccgccccaactcccatggttcagcgactcactggttccctcggtcgtcccatttcccaaaacccaccggaacacacaactactccgtcccggtagaccgcacgaatcgcaaagcatgactccgggcaaactgaagccgtcgatggcgcaaggtgcgcactctggaaccttctgtcccctcggccatccccccttccccaagaaagccccaagcatataaacccccgactcccgtcgctgtcaaggcacatctcgctcgcagcgccccgctagaatccaaagccaaaaccccaatcgcacaggagagaccgagagcgaggttttccatcc

SEQ ID NO: 12496 - DNA, 488 bp, Zea mays
gatcgattacgaattcaccatgtcatttgattcgtttgatatagagtaccatatttttgggcaaaaccgcaaaacccaagtgagaaagaagaaagctcgttgccgagacacgaaaagtttatgaaccaactgtttgttgggtaggacatacggtgtaggcagtcccagcaggtttgattataaatttggtggaccacctaaaaccaagatgtgcacggacaaacagaacagaaactgacaccatgtacccagtggagtgtgcatccttgacctgcctccacatttatggcgagtttaggagctagaaaagagaagtagattggagagataaaatctactccttatttaaaattgaataagaattagattctagcacatccaatcctcatcagttttgtagctcccaaacaactcgatttctaaaagggattcttatttttaagggaaaataaactaatttcctttaaataagaatcccttaaaaatat

SEQ ID NO: 12497 - DNA, 65 bp, Zea mays
aaaataagtgattcgtttttagcccttataaaaagaaaacggattcttgaacctctttcacgctc

SEQ ID NO: 12498 - DNA, 81 bp, Zea mays
ggtgcccaaaaatagacaatcaagctcagatcagatgtgtctttgctttggtttgattgcaaggagaatgaaaaatctttc

SEQ ID NO: 12499 - DNA, 158 bp, Zea mays
gaagaagtgcagacgaaattaaggaatcttggcgaagtatatataaatacgaacacgtatgcttttcacagttgttgaaccttgagactactagctagagagagaaatatccaggccgaaggcgagagaggtctgagcggggagacgacgcccgcgcc

SEQ ID NO: 12500 - DNA, 694 bp, Zea mays
agtatatctattaagagccctgggctctcaatagctaaaaggagccctagtctaattataacttttggttgaatcggaccgaactgcaagtctgcaacccggcgccttggaatacaaagtcggtccacgttgtggatcgattcatataatcatatagcgtcatcatttgtagtccccaatcatccgacgatgatcccctcgattcgcggcgccctcgcctccaccactccccaaccacccgacgccgacccccctcaattcacgcccccacctgctgcatcggctccctctggcgccccgcctcctggcccagatccgtgcaccccttgccctctccggactcgatgattcacagatctgcccagctgcccaggcacagactaccggcatccggatctcctgctccactgctcgccgccttggggctcttcggcgttggctcagcgcgacgagccccccaatagcctagttccggatcccccaaccgcccacgccccacagttcaagcaccggccaccgatgtctgacgaacgagcgaactccccgcggatgcaaggaggaggaggtgcaggagcgaccgccgaccgtccgcgtttcaccatccccttctccgatctcaaggtaacctttctcggtgttgaaaccatccgtggccacctggcgagctggtgccccgcagaggtggtgctgaagc

SEQ ID NO: 12501 - DNA, 605 bp, Zea mays
tttttgagttagagctcgtggagctagacttgtttgatagctgaaatagacttgaaattcttatgaagctctcaaaaagagcctaaaatttagtaggctagatgctagaacctaacaactcctatatatttaaataactttttatatattatggtatatgacgacatatcatctccccctcttgctgtcttggccgcagccgtcgcgtcgatgcaagttgagacgtccctgcctggctgcctggctccctgccgcaaccgcatcaacgacgcacggcgccacggccacggcacggcaccacgcgctcagacgtccacgggctaccaaccccagctcaccgcactcaacccattgctgccacggcgatcacctcacccaccccgcgcacttttctcatcgcgccaacgcaaacaccacagcgcagcagcaagcgagctaactggagtacaaagcaagccaattcgctctgtgcctgtgccgctgcctaccgtcgcgcgagacgggcgagctcctctcccggccgccgacgccgcgggggattccttttccccggaatgctctgccgctccgtccgggcggaagaggagcactaggcggcggctcgg

SEQ ID NO: 12502 - DNA, 455 bp, Zea mays
cctggagtaatttggatagcagtgtattgcaacatatgtcattactgtaagtctacatatagcatggtaccaggtacgcagccctcatgcttagatctaaaccataataccaaagctatgcaacgatcaagagaatattcccatctcccacctggagtaatttggatagcagtgtcactcaatcagagcaccgacgatgagtggacagtgcaaggattcagagcaaagatgttaatggcttaacgcacacatatacacagttcctcgcccaccaaatgatcgcaacaccgaggcactcggcgctccaataggtataggagcattcgcgtgattcctactattaaaatccaaatctcgcgcgcggcgccggaccttgcttggaggcaatacctgctcgaaatctaatcctaagatctgaactagtaacaattaacaaagtttctgatcctacacat

SEQ ID NO: 12503 - DNA, 1392 bp, Zea mays
ctaccagcactttaagtgtttgagttgaaaatccgagaattttgacaggtaaatatctgaataattagggtggatataagaggcgaataattaatggtgttagaccgtgtccagcagttcactcatatggtcatccaaaactatttacaagtagagtttgaatataggaatgatgatgagtacactgatgtgagattgtgttagaatatgcataacttttctactatgaaaactctaaaaaaatttatcggttttcataacaaggtttaagatgatcgagtgttgtctgcttgagtgtccacataacttatccattcaaaacaatttaaatatccaaataatcgatgaaactttttagacgcatattcggtgaaaagtggctgtgttgacatggaaaaggccccacccattttcagccccataaaaaaattggtggtcagattcttattaaaacttttccttcaaccattctaattattgctacgctatttttcgttttaaattatatgttgttttatcgtaagataaatactatctttaccattattttttcaaagaaaatgtatatatgctaacaacataatatgtactctctccgtttcaaaatatagttctttctagccatcttttttttccgatgataatgaatgtacacaacaacactgcagggaattttgggcggtcgaatcctggccgcaaaaaataggctaccttattttcggcggcttctgatcgtcgaaaatgatctcgtgtccttatttagtctaaaacaaattatattttgtgggcggatcatatgtttttagattcactacgacacatgattccataatatatataatccatatattatgaaattttgaaagagaaaaatatttaactgcacatcagtgtcaatttaagaaaccaagtcgacattgttgagtttttttttttttttttttggaatgacagttgctgtacactgatgatgttctggaagaagaggtactgtgaacaccacgttcaagcttccgaatatcttccatatatgtacgtctctctgctagctacctaccatgtgggcacatgtaggaataatcttctgtgatacaacaaccatgtagccaccgatcctaatgagtcatgcataatagcagacacaggcaacagtgccccgtgagcacatgcaggatcagcagtacgacctccgactccgagctactgctcaccctctcgggctctcggcccgcccgtatgccagtctgtctctggtacactccttcatttcatcgcctagctagctactatatagtacgacctgcctgccttgctcttgccctgtgagcagcggcgtgcgatcgatcgaggcagtcgtagtaataagccaacaaacaaaccggccggaacgcc

SEQ ID NO: 12504 - DNA, 745 bp, Zea mays
ggtcgctgctcacgaggcgccggtggaggaacgacgagtcgtccttgtacagttacttggatgagtactgattgctggaatgttggaactgaaaaaagtctggtgttaactgaatcttctatagatggatgcgatgctctctgctttgccaaaaggttttggtttcccgtttccattcttcacttgcccatggtgaaagcgacgggtagatgatgcaccgatccgatcctacccaccctgccctggtcctggtcctggaatggcagaaggcgacgacctcttcgttggatccgtacgtcggccgtgggcgtcgccatcaggacagccaccactacagcagggacgcgagcgcggggacggtggtagaatattactgcccggtgcgcgtcgactgcgacgcggtggccggagcagctgctgctgctccatgcgccttttcttggcatctactaatttctctgtttgttggggctgctgtgacagtgatgtatgtatgcatcgagcccgttgttaattatccatccggatgcaatcaatcaagcggagaaggacctgggcattggccactgccaacccgccacaagtgacggccgtcatgccgacatgccgtggccggtccaccactaccttcccgacgggccgcattggattcctcccgtcctcctcccgtctcgccatcgcttcctgttcctcttcttccgccgccgccgtacgatcacactagcaccgccagccgcaaggtccc

SEQ ID NO: 12505 - DNA, 1500 bp, Zea mays
ctccatgacagatggcaaaaccacagttttttccccaatttaattaattacagtcctagctagctagtgttgcttgactttgcttcgggcaatgtgtggccaatctgccctggggagcagattctgtgggttgggttcacctgcgtacgtactttacctgcggatttcctttgccatgcacactccctcaattaacattttatattttggtagtaagctaaggttttaatctttcacaagtcgtggtctcacatactgtcatgacgatgtcgttcagctaagagaaaaggaaaccccctttctgttataccacaacagaaatacaaatatttgagcatagagatgagaagagagatggaagaatctgtccgacttcgcgatacggctttaacccggttgcggcttctacaatattttgtttctatggattgcagctgcgggcagccgaacaagatagttcagtcagccgtcgcagtagtagcttagcccactgaatcctgatggatccaattccaagtgtcaaatgtaactatcagggtacatttttttacatacataaactcctgacatcaggaacacttcgtttttttttcctgtgatgcacgcatggatctggccgtgggttagcttgggcaggaaagggtgttagaaaagacaagggccaacatcgcaatcgcaaggctctggaagaaagaactggccagcaatacccagcttcagttgtttggttccaagttgccaattattgacaagacaaaatgtacgatggctatgcatcgctgcaccagaaaacaagcatacatgcatgcagcattatccgctggagctgtatttaaactgcaggaaagaatctgtatttaaactgattgctacaaggatcattacaaaacaagcaacgggccgggacttatcatgagacttgtttaagcccactgtcagtgcaataaacaaaatccagttatgtagagaagtccaagaataaacgtacggctttaccttcaagaatctgtatatttttttttcttggttcagaaaacaatctatatttttcactggttggagtttgggcgtaggttgccgcgaaagctttcaccaacaatcatgcatatagaaaagggattatattagtataacaagtacacacagcaatgtgtgaatgtgaataaacaagtccatccaggccaactgcatctggcaattaaaatcatctctcccggccgagtaaggacaggaggcaccacccgttttttactctcaataattcccagttggctgttctgacttgacacagagagggatgcgatgaacaacacaagacgccgctgtttattttttaaagaaaaggaaagaaaagaagaaaaggacagaaactagaagttgaccccatcatttgtcccaagaaatgccagcaaatgagcttgcttccgtgtgtataagtagtggattagctgaggctcggggtggttcaggtgataaggaaaggtagtggtaggaggatag

SEQ ID NO: 12506 - DNA, 274 bp, Zea mays
ggacacgaggattttgccgatcacctggtgactgtacatagctgcatacgtgacctgaccttgtcttgtggctgtaaaagtgaaaggtgtaattttggggtttgtctgtagatttctagtgacatatcgaatgtgtaaaaaaaaaaagttgtcttcagtgtatccctgcagtggttttagtgcatgtatacccctcacgacctaggcacagaatcctcttctagtgtcaaattgtgtagtgcttgttttctttcttcgatttttttccaacgta

SEQ ID NO: 12507 - DNA, 60 bp, Zea mays
tgtaataaatatttttggaacgtttcggatttaacttatgttgtttctgtttcaatcaac

SEQ ID NO: 12508 - DNA, 579 bp, Zea mays
tgtgacacgattataggatgataattttaacccgtaaatctgaaacctaagaataccaagtaaacccacacctaatctaaagttttgtagatgtgagtttgagtttctatttcaatacacgggtgacctatacctaacccaaaatttggtttgttctttgtgttatgcaaaagtgattagaatataatagtaattattataaataagtaacttaactaatgattcgttgaacgtttggttgcttggttgctgttgaacataagaagacttaaaatccgtacataacaaattaattattattgttacttaattattaattatttatagctaaattattgtttaaaagtgtactcaataaaattagtgggtgatctgaaacccgacggatttagatgtagatttagaattgtatccatgaacgtaagtaatgggtttagataggatcaaggtgaatttttgctccatactatcccaattcccaacccgaccattgccgtccttacagtcaactgtgttctagacagttgagttcaaaaaggtgaggcggcgagatcgaatcaagcggagcggagcctacac

SEQ ID NO: 12509 - DNA, 127 bp, Zea mays
ctgcagggttattataaaaggagcgagatggacaagcgccacaaaccgatcgagcctcgacgagcgagcagaggactcatcctagctagctaagctgtccgacacagcacagcagaccgatacgacg

SEQ ID NO: 12510 - DNA, 733 bp, Zea mays
gatattaattttttaactttgcatgcatgctgagacccactaaagtgacatgtgagtgagtgagtgagagggagactcatgcgggaggcgtagggcggcatgcgcttgggcgcgcgattcgatgcgtggctggtgcacgtggtccgacccaggtgatggatcattgggtcgagtaccctaggtcatgaatagatcttctatatatatattatttacttggtgtttgatatgaatatttttagaaatatattaactgcttatattggtagtatgtatttatactttgagtgaacctattccaaagtttcctgttgagcaatccacgtatggctaatcttgaaactcaaacccttgtgggcttgttcggtttaaagtagattgaggggattggaggacatgttccgttcaaccttaatccatatgaattgagggggattgagtgaatttcaatacataataagttaaaatttcttctaatccttattaatctcctccaatctatatggattaaaaataaccgaacaagccgtagggacttgaagaaaaattagtgtattttcacctcaatgctctctaatctccagaggatttaagtttccaaattagtccgtagtgataattaatcctgcaaaactacttatatataataatagtacatttgatccctttcatttccaggccccaatcccacgctttacataccatacatacaaaccacttcccctctaaaaaa

SEQ ID NO: 12511 - DNA, 116 bp, Zea mays
gttcgggcaagaacgaaggcgtctttcgcttccattgctgctgcgagggagaagaagccagaacaagaacgtgagacacacatacatcgtgtgaggtggcgtgctgacggcgaggg

SEQ ID NO: 12512 - DNA, 1077 bp, Zea mays
tgtttttctagaatttaattgaaattttcaatttggtcaagtccataaatccaacaaaaaaaaattagaacatctacaacaatgtcttaaattggtgccacaaattgaaaatataggggtgatactgttggtgctctaaattttataaatttttggtgctctaatttttacaaattataccgatttttaaattatatgacatttttataggtcacaaggagatgctatcatggttttttgttttgttttgcaaaaagaaagtcaaaattaatcacgtatgtttttttttgtgataaggcagagtgaaggaccgaaggatgatatcagtatcttcgcgggaaactacccaagtgtcaggttaaacgcatgtagcaagtgcatgcaccggcagcacgtgactatgtcaacgtcgtcgaaaaaatcgttttcgattcacagaagaaaaggaagaaaagaggatgagagtaaacaacaacaacaacaacaacgtcactttctcacctcaggtggctcattagtcattactcagcgcagttggcacgagatcatgatgaaacgcgcgttagttctattagcagaaggaaaagacaggtttgatcgggccgtatcgttcgtgctcggtgctcctcacggatggagtctgccagatttggccgacaaacattgtggctcgatagctggcagattttgcaatttgcactgccacgaacaagttgaagaagttggtcagaacccagtagcgtggccgcgtagggggttaacttaacaactcgccgccggcgagcattccgctcagcgatcaggcacaccatgtactgacttgctgagctactgagtactgactgattgctaaacaggtcgtgaaccatgtccacggcgctgctcaaagaatggtccacgggccacggcgcttctccgactgccgctactacctctacaaagcgagaaaccgcacggcacgaggctccccaaattccccatttttacggacaccagcaagccacgccacactcccaatcgccgcagcagctggtcccctgctcggctcgtctgatccagcggctgaatccgcaggcc

SEQ ID NO: 12513 - DNA, 485 bp, Zea mays
gcgttggtccgtgttagataggcgtcaatgttattagcgccgatccatggacttattttttaaaatgaaactcaaaaagacatatttatgaaaataaaataaaatagctaaattgcaaaaaaaaagttggcggctaccgaggtaccgtcctagtccacaaatgcatttgaaaggcaaaggctgcaactgtcgcagcaggcccgcaagcgatgtgcgatcacggcccagcccaatgcttaacagcgaacgtgcacgatccagccgaaggcccgaataaacagcccaacacgcgcccccattgctttcctttggggtgaagggagcggaagtcgccccctccctcgactcccccaggccccaacgccaccgtgtcctcccccgcccacagccgcgtcgcgcaccaactccaattcctcctctccgagcgcccccacccacctcgacgcctcgcctcggccgttgagatctcgcgcgcccgcggcggc

SEQ ID NO: 12514 - DNA, 755 bp, Zea mays
ggaattttattgtcatgcaaaaaaatcaagattaacaatgcgatttgaaaactcttggaaaatatacagatagagttctctatttattttatttattaattaacataatcatcgttttaccaaaatgattttaagaagtttatgctcctatcctaagttttactcatgtttctttttgccaatgaataccaatgtctccttaaaaataaaaatagtttcaactttgcgaaatgagtgaaacttacagaattacagaaacacccgggaatattattgttccggcacacggctgggctggagcaatcacaagcataatatatatggatgggagatttgatatttggaacctaatttgtacgtttttcaagatttatttattataataatatatagagttactatacgtcattgacatatggatgagaacctgaaaaataagaattgcataccaaatcttaaaatttgtctcctttcccacaagtccccgagagcagccgcgaagagagatcccgcgctcaaccaccgattctcggccgcggcctccctcggcccctccttgatcccttcctccttcccttggtggccgccggggacggggagcgaagaagcgtcccttccttccctccgttggtcgccggggaggaggagtgaagaaacctcccttcctcttcccctccggtggtcgccgaggacggggagcgaagaagcctgttttcctccttccgtccggtggtcgccagggacgaggagcgaag

SEQ ID NO: 12515 - DNA, 935 bp, Zea mays
ctcggtacccctgaaggaagccctgtgtgatgagatggatgtagattgcaagggaggtggagtaggaccccggttatgtagatcgtagaagttgatttaggatccccagttgagagattatcagtgacgctttaactcttgtatttgtatgatagcttatgcgtagcgtagtcatgggaagtccgaggtctgtcctgaaagaatctagttaggttagtcatatagagcctagaccttagatttgatgtgtatagcactggactactggagatctggaatacgggaatccagttttgctgctgtatggaggaccaataaactcagaacaggatgcgtgtccaaacattaccttgtggaaattgagctttattgggggttggtattgtatgtttttccctgcaaaatccagtttgcattcatctgcatcagaactgaagtcagtacggttttttttgtttcacgtcttgtggtggttttttacgtctggaccgagtgcagtgtcctaggtggcaaaccggccacttgcgcatctcacggaccgggctccgtcccacgtgttcccgggcccgcggcgacggcctggatggatcctaggtggcgcgcatccacggaggcggaatcgccaggtggcacacacttatcaggaaacgaacggcgggaggcgcaccacgttcagagctgaatgcgttcttatccgcgcgatccgacggaccccgcccatctccctccattgctcgctcgctcgctcttctccagcagcagctccttcaaatgcaaatctctttgctgccgacgcagagactcgccaaatttccctccctcctcctagccttctcgtcgctcctgttcttctcgcatccccagcccaggtggtgtcccctgtcgcgttgatgcatgctccctcggcggtggccttgagctgaggcggcggagcg

SEQ ID NO: 12516 - DNA, 561 bp, Zea mays
gtgcgtgaagtaagaactctcgagtagctagctcagtcggcgtttaaagttagttgactaaaaagttactggtagaattctaataaataactaactaattattaactaatttactaaaaatagctgatattagatagaatatttgatacctctaactaattttagggtgcgtttggttgcgggacagatagggcagggacattccctggcgtcctctttcgtccctccaatttttagggacaacaggggacaatactgggatagtcctgtcccaacacttggctcagaaccaaacaacctaatttgagggatcgtcccatctcatctcgtcctgtcattgcaaccaaacgtacccttagtcattaactattatctctagtacatttaaaacaaaactactaaattcttctctactctaaattaactattagctctaatacgttaaaacactcggtctaaagatctacatgtataatatatataaaaaccatagctgcgcgagcaccgtgtcaatttgagaaacagacatcgctaaatcggtaataaatcaaaagctgagag

SEQ ID NO: 12517 - DNA, 47 bp, Zea mays
agtcaatgtagattctttttgtgctcttgattgagctgaaactgttt

SEQ ID NO: 12518 - DNA, 125 bp, Zea mays
ttgcatgcctgcaggtgaattgttcaggctgaattgatcggtggaagctgtgcattgactatttttttaatctcagaatcaaagagagaaattgaactgggaggctgctaattgcgagagaagtg

SEQ ID NO: 12519 - DNA, 252 bp, Zea mays
ctcggtcccctggctatatttgctaaggaattggttgaaaggttaatatctcgactgaaagaagcacatatctgagtggtactacccttaagtatggtagctcttagttcagccaaaattatgcgataaaaaatacctgtacaagctggataaagcagaagtaagaaaagtcgactccttttgctatgctaccattttcatgtcgagtttgacactacttctcgtgcaggcaagacagatccttatgttgtc

SEQ ID NO: 12520 - DNA, 1083 bp, Zea mays
gaagctgtggctctgttttggtattgttgtaactctaggtcaatcattctaagaaactatcaattgatagatagcatcagctatttcagttatttgttagttttgcgcttgtactgtgtacttatttgacgcaaaatgtgcaaataatttactttgctgtggtgctctacttatgaattcatttcatctatgagttctaagaatatatattttttgctattaagcatattgaaattataaactggcaaaagaggaggcaatgaacttatgaacagaaaatgccagaacatcagatattgctctattcccttactgtttattataacaacaaaacccttttctttgcgtttagtgagtcagcactaagcagattgagggtctgtttggttgggctgtggctgtgaaaaaagttgatgtgggctgtgagctgtggaaaaagctgttgtaggctgtaagctgttaaaaagctaaaaaccgtttggtggagatcactaaaagtagttaaaaattcatcgatatatgttttcatagttccatctaaaaagccactaaaagcaggtccagagttgcttttagatttaaactacgagaaagtcggcttttaaaaaaagatgcttcctgaatccagcactttggttagcttttggtttttagggggttaggttttggtttttaggggggcaaaagccaaagtcaaaagtgaaaccggccctatttctctatcgcagctaagataaagaaatagtttttaaaaagacataaaaatccacggctgcagcctgcaatgcaacacagcctgcccgctgcgcccggctttaaaaggcgcaaaagcgaacgaggcaggcgctcctccgcaccaccgtacaccggacccggagcagctcgccgccgtgaattcccgtttcccttcacttccgttgttccgcgtccgaattttgcagggcattgccgcggcgaccctaaccctccctgctggctgctgctccgcgcaggaacccagcgctgaaccgacggggagaggcgaggccgcgctttaccccgggaactacgaagcaacgacggcgggactgagcaggcggggat

SEQ ID NO: 12521 - DNA, 571 bp, Zea mays
aaggaaaacactaaaagtatgcaggcagtatgagggacacacacagtttactgaaactcccttacacagacacatacacaccgtgttcactgaaacattcagatttcactaaactgcaacttctccaaacaaacactatctgcggctcggtcaagtaacgagcctcggctcggctcgctcctctagcgagcctaaaaagtcggctcggttcggcgagccaacgagcctgaccataagcatgaaatcagtctccaaaatataatataaagtctcaaaaataatttaagtgacacgtcttaaattagtaaaataaatatatatcatataatatagaaaataagttaattttgtacagtaatctaaaaaatataaattaatcatctatttagtacctataatatatgctaattaaaatttatataacaaaaatgttgttgttcgagccagctcgcgagctgaactggctcgctctggctcgctcttttattgagccagaaaaaaactccgctcgaccttgttctaagcacagtttctggatcggaggagcatccccgcctaggtctctgcagcc

SEQ ID NO: 12522 - DNA, 1118 bp, Zea mays
tagttgctccgggaagcacagaagcatgatgtcctcgacgcgctctgcgccggcacgaaggagccaagcttggtcgtcagcgtcggtcttgagcagacctggcgccaccactgccgcatcgcctaggggccgaagccgtgcaggagcaccaggatgctgggacctcttgggcagcccattgttgtcgttggccgagtgcagtaggttggcgacaatggcataggtgaagaggaatgtgtagtgggcgcgatggaaggggagatgcgtgggcgaggatcgcggggacaggggtgtccatggaatggcatcgatggaagggcgagatcgcggggcggtagcgagggcggacgcggaggattatagaatggcgctttccatagcagtgaatggacgcctatattgggtccttatagagtagtagagatagtgatggtctggtgttggcatgccattttaacaagttgtgcggctagttgtgcatgttggtaaagcagacatgcatttttgcttatatatccttggctctcatatggagagacaaagaaagaggcacaagttatctatattatctatttctcctaaacggaagccatgactttcacgggcggagccagattacgatataggagggggcaagcaatttatcaaatattataaggtgaaaaactatcgtaggatatatacacatgaatatactaatttgcgtatagcgtagacaatatattaataaaaaagacttacaacatataattgtatattaattatctcctcaaacagagatcaaaatgaattgcctctacgatgattggccaaattaaaagctttaattatatcacgagagctgatcataagtgccaattctatattagtatagatgatcatgtaataactaagatccttgtcgaataaaataaaccgtaattttgcacgtttagttacytccactttctttttaccacttgatagatagtcggttactcttcacggtaacacgccgcagcggcgaacaaatcttgcgccgcacgccgaaccctacataaacacaacaccggcggtggtacggtccagccaaataccaattgccaaaaactcccccctctccctttctctcgatcgga

SEQ ID NO: 12523 - DNA, 1306 bp, Zea mays
ggcctggttgtttggttctttggttcggtttagttggtaggcgtagggaaaataatccgaaaccaagaaatcgaaccgaaataactagaaccaaaaccgaactaaccgaaaccratttgaccgttaacaaatttggttcctatttcgaaaaaaccaaaataaccagtcgaaaaccaaaataaccagtcaaaaatcgtccaaccagtcgccatagccagcccgacggcctttcgatttttccggtcggtcccttcctagtgtgtaatggacgcgcacgcgtgtgtacgcatatggtgtaatgtgtagcagtatgagtttgtggcgtccttgtaccctctcaaaaaaactattagtgaaaaccgtgtaaatcaacacaagaataagattctctttgataggacttttttaaaggcttctctaataactctttcaaataatctaccaaatgaagggctcacctgttggcttctccataacaatggaaaaaagagctgcccctaggaaccaagcgaagccaggagcccaaaaaagaggcttctttaactcttcctcttacgtgaaaataggagaggtgtttctaatcaagtatggtgatcctgctgagtctctttttacacataaagagggaactgttttattagaaaagttagagtcaaagctgaagctcttatgcaagaggtctaacaaaaaggaggtgagaggaatttttaaaaaatatcaatttccaaatcaactcttctaccttctatattctatatattaaaaaaattatgttattccaccaccttcatccttgtgtaacttgtagctaccgtcgtacaagttgtttccattttccagagacgcgatagccgctaggaagcctaggataccggatttccctggtccgggggttccgattcccggcgaaggaaacgaaacgaggcggcggaaggcccggcctcgaggaaaggcgcacgcatgcgatgcaacaagcacatgcgccgccgtggtccgggagcgggagggcggggagcagggctggcattttcagtttcaccacgcaaagcgattcgagccggtggcgatctggtcgggcgagggcgcgacccgcctgccttggacgccacgtccaagctaggcacccgatgcggtgccatcgtcctccgggcacgtctcatggtcaccgtcgtcgtcacacggccggtataaagcccccaaaacaataggcttccccgttgcacttgcatcccctactgaatctagctacgtaccatctctttcgaatcgcgatcaagtttatttggtgcggggtcggaacaggaag

SEQ ID NO: 12524 - DNA, 1500 bp, Zea mays
cagcacgcgacgggaaaggcccaaagggaggggaggcgagaaagaaaaacaaaagatgggatcttgaggaggaggtgctgggggtggggaggcggcataatggcggccgcggtgtgctagcgggctaaagggggtgcactactgattgctgatgggttaaaggaggtgcaggtggtggtggagatggagtggacgcgttcatgcccgcgcctagctagctagctagcttacctgtccacgcctctgtgctgtgtcctcttggctttctctttcccgctctcctcctcgcttgccccccgccagctcgatctccagggagtggactagtgcagggagggagggagggaagaaaggagtggtgcagctgtgagtgaagccacctctcgtttccttgattgattggagccgagccggaatgtgatgcgagagaggtaactcctggccagcttcgtcccaacgtaacggtgcttcgtgtccgccttcgttacttcctgttcccttcgattttgtctgtgtgctagctatgtgatgtttgactacttcttcggttttgtcttggtgccttcatttggaagtgaggggggcggggaacgtggggctgtgatccaggcagggtgccttgatttccaattccaagagagggggtggggaatgtgggactgtaattcagggtgccctgcggttaggttttgtgccaatttgatgtgatgcctttgagcatttgtgcccggtctagagtgaggttcagtatgttgttggttcatgttcttgttgttctagtaattgtttttactgcttgcggtgcccttgcttcgaacatgctaacttgctagggtttgaacagagatccagactattctggtttgttcaaaggttgcgggctccaattaattactgaccggtaggaaatgtagagatccaaactattcttctttcttctttcttacttttatgtggtagtcatgtgatgttctagcagttcctggttttgatttggtgccttagtttgcaagattggaagaggcggggaatgtgacactgtaatttagagtagcttttggtttgcttctgtgtccattcagttcaatagtgaggttcagcaaattgttggttcctgttcttgtggttatactagttgttttacacttctataccgtttcccgtgctcctgattccaatttgcttacttgctatggtttgaatagagatcagaactattttttgtctgtacaaaggttgcatgcaggcttaccaattattgagcgctaggaaatttggagaacctgagcgctgcaatgctttcttgtttcttaattggcattcttcgctatacacagtgtatcctaaattcctaatttagtcgtttgcttgaagtccgaactaaacatttcgacccttgtccttcaggtgtgcagattagaactgttcayagcacacaactgagcaatcctctgaaggccaaacacccccttccagttagccatctctgaaggaacatac

SEQ ID NO: 12525 - DNA, 138 bp, Zea mays
ggtgtgacacgtactctgcaatgatgagacaatgcaaattgtggcatatatcgaagtctgcataataatgatggttgaaatatagtagcgaaacggctaaattaaaataacaaaaattatgtatggccaggatcacaa

SEQ ID NO: 12526 - DNA, 1211 bp, Zea mays
cttcagacgttttgttcaaaatacgaattgaaattgcatgatcttctaaataacactttgaccattcatttactacatcttacatttcatatttatttataaaaatatgattattgaatagtacaattacttataaatctaacaatatcaatttgtgttataatagttaaaaattgctagtgagattattagttacaacttttaaagtctgattcttgatatgaaagagaatggtggtagcagaacgcaaagttccagtaatattaatatcattccgtacgtattgagctcttgatgcaatgaaaaggcaaattacgaacaagaagggctccagcgttggcgagtcaatccagcccagcacacgagaccaggcgcacacgtggcggaccagaactggctgcgacttggcattccccgcgtgctacctcgcgtgggatgacgccacggacgagagcaacaggcctccttccttccaaactgcatttggtaattttcattcacgggaatattgctcagttgattaatcgaatcattttgtgctaatccaccacggagaagaaatcgcaaacagcggcgagcaagagatgcccgcttggcttcgcgtgcacggccccggtgccaagcctggcactatataaaggcctggccgagagacctttcttccccagagagacagacacgcctcacccacaccacaagaacaccaaagccacatcccatccatctccacggtgaggcttgagcgatccgagcaaaaaaaatcatccgcgacgcagcgacgcaggtttgttctctgatctctctggttcttcttttagcagcagggacgcacagcacaagaaaaggtccggttcaagaggctcttctgttgggtttttttttttagaatcctcaagagaagcgtgttcttgggttaggatttttttctcacctcatcacacctctcctaggaggaacagagatccagagaaccttttttctcttctggatccttgccgccttttggcgttcgaaagggggttgttttgcaataccctctctctctgtttttttttttttatcttggcacaaacccacctcgtttctctacttttattgaggaacagagctggttttccaaaaaaaaaaattctgctttgattttccataaagaaaacctctcagcctctttcttctagctccatccaagctttctccatctagtagttcca

SEQ ID NO: 12527 - DNA, 1500 bp, Zea mays
actcacagtggatgtagggtaatacgctccgacgacctgaaccactataaactcttgtgttcttatgttcatctagaaggccaggcaatcacctaagcctactcctcatccgaggatcagggcaggtgcaatccgccacccggccagaggattctcccctctgacacgaaggaataacagctataagctaattgccatttcgaatggttatagattgggcggaactttttattgggggagaaacatatatgacaaagtggctactatgtcttaaatatcccatatatatgtttataatcacttacagctgcaggtcatcattaattgttaatgggacgtcttttggattatgcactaagcactatggaccagtaaatagctgcaaaaaacagggtcgaaggaatcgatccctcaccccgggaaggccattcctgaccaaggtacacaaggtcattttttatcctgctgtgtaaaaagcctttgcaagtagagtgccatgttcgtcaaccccatcgaccaaaaaacttggtgactatgccagtaaaaataatcaaaccagtcactacttttgaatgtgtgcatatttttgtaagaaaaacaaatgtgtgctatgtgcatatactcattggagtaagacccccaaagatatacagctgtaaaacacatcacattatattaggttacaaccttcatgacctgtgacgaccataacagaaaaactaattgataataaggtaaatgatttgtcatgtaaccatggacagaagaatatcatataaaagcaaccacagtttatgttagtgctgtgatgtccagaagttagtagcacagtatcctatatagccaaattttgctagttgagctgagtgcaccattatggactacaaactggttgcctcgctaagctgtaatgctgtatacatcagtacaagttgatctagcaaagagtatgctagcaaggtaatttgaatttgaagtgaaagtacagaaattaaaccaaaacaatgaagaatatggaaaagaagtgatacaaagcagttaactctttcctttatgatacagattaaggtggatggagaggaacaaacacatccaccttacaaaatatatgagggtggaggctaaaatagctcaaagtccaccaaaatttctgtcatataaaactcataggcctacctatttttctgaatagataaaaaagaacttgtagctcagcaataactaatgaagatgaaacatctaagatcccttttaggsctagtttggatactttgggattagagtgttttggagggattggagagggtgtaaatctccaatagatcaaatactctctcaatacatatcaatccactccaattccactcattactagagtacccaaactaggccgtatgtgtgtgtataagagactcgcgggctcgaggctagcaaggatctcctccaggactactctgcttctccatcagagagccacaagagagacagagagagattatt

SEQ ID NO: 12528 - DNA, 1500 bp, Zea mays
ttgttcttcctccccaacctgctgcccctgcccatggtcgtagccgcgagctgaccgacactcgtcgacgcgggtacgagcgagtcggtcttgctcctggcctttctccgtgcgtgccgccgaggataacacggtggtgcctaccacacttaggttatcatggcgatgaggagtccaggtctgagatattggatagccaaaggccgtagcacgacaacagtcggcatatactagagtcggtggtggtgttatgtcgcctcagcgggtctagggctaggaaggcactagcattctctcgcccttctcggactgacgcctgatgcgggtgcctctcagtttggagctgctccggctgggcttctttcttcgcttgcatgctctctctccctatatgtatctagcagtatactacctatgtcacctcccgatggctaggtcttcgttgtgtccttctccggcaatgaacaggtatgcccgtctcttcccttcccttcttgctctacgaaaccttggaagtgggggagacgagggctggcggtccctaatttgctgcctatggtacccgttcgatggctcggcattgcctgtctacatgtcctttccctcaccacggtgtcgactcgttatgtttctaccacttctatgtacttgtcacccatccttttgtcattgcaaaaattattgtgttattcctctattgttttgggtgttagtttttattgtgataaggactgagcataatttgggtgtgttaatactttatttattgtctacacgtggtatgtgttcttctgatgatggctcatggatcctgcaaaatatgtgttaggatttggagatccatgcgggcactacaacagggtgcttgtcccttgtgttcttggctcttgcatgcattaggtcatttctaagaccacattggcgcaataaactccatggtgtttgaagttgatgaattggatggagcagcaatgatttgtcacgctaacagtaaaaggaaaggttatttgttggttttaaatgttagtaatttctacaaagtaccataatttgtatggagcgcatccaatttttattgatgcctaactttagcaaccactccatattttgatctatctttgttataagtgtgagttcgtgtgacttattttataaacttgagctcacaaacttcctcttatttggtcgctgtatggtggaattatgtcattctataatctctgttcgttcagtcagtcgttgtggactttattctaatcgctcacttaattaatcatgttgtatcaagacatattggatagagtaaacaacaatattagttagctaaataaaaaaaatatcgaacagtagagataattattaaaaaatcttgagattttttttggataatttacgttgaaatgcacaggcgactagtacaggccaccaatctggctcttccgtcaaagcyctaccagaaccctacctcccgccgccggccgccccctcccgcggctagga

SEQ ID NO: 12529 - DNA, 270 bp, Zea mays
cctgtactcccatcgggtttcgggtacccattaacatcgtaaggcttggagtgaacaggtggcattaatgctcgtcacggtgctgatctaaccgtccttccgtagttcgtgcctctgcaccgtccgatcttaagttccgcgcaatcctgggcgtccctctccgtcgtgcctggagaggcttaccgccgttctcggccacgccgctgcgtgcctgcgttcctcctcgtctcctccgcagctccgacggcgccctcgcccgcgccgcctgct

SEQ ID NO: 12530 - DNA, 423 bp, Zea mays
cgtcctcccgccagctcgacctccaagccaaggacctcatccgcgccgcgcgcgccgccatcgccgactccaagccgctcttcgacccgcagctcaagatccagcgcctcaaggacaccatcttcgcgcagaacgagctgctcgcgcgcgccaagaagcgcggcgccttcgcctccctcatcgccgccaagtccatccccaagccgctccactgcctcgcatgaccgcctcaccgcggagcggattgcgaggcccgaccagtacgcggacccggtgccgccaccgccggcgctcgaggaccccgcgctcttccactatgcaatcttctccgacaacgtgctcgcggcctcgtgcgtcgtgcgctccgccgttgccaactccaacgatccctccaagcacgtcttccatgttgtcaccgaccgg

SEQ ID NO: 12531 - DNA, 306 bp, Zea mays
ataatcaccttgtaacatcttatttttgcgtatttactgatctaagtctcagttttcacacttatttcttccttgagtatatttaaactgatattctgagcaagcataagcattcagacaaatatatacttttaagcatggcattggttaagatgaaatcccttttgggattttttgtcagatctggaaataatgcgattttttgtaacccttgctggttggccattgaatcataaataacccaggattgatttttgaagatggaaaaaatatggtattgaagttgataaccaaggattacataac

SEQ ID NO: 12532 - DNA, 1500 bp, Zea mays
gtgccccatactattcacgctttcattgaaagtcattattgtattctctccttcgagcaaaccgaaggtactgatgtaatctaatgcttgtaatgtttcatttaacgtgtaaaatgaaatgaatacttaatataatattacattgttatattatcttcatgagagatgaagacccgttcttcatcgcattcgtccaagaaccattatctttgagaaaagataatgctttgaaagacgaaggtccttaacatttaatatttgtgttgtcttgcttttgattcacaaaattgagaacaagtaaccaacaatgttgacaaataaaaatagaaataaaatatgtaatattttattaggatgttgggttgtagaggatgaaataagggaaatttatgagagggagtaacgtggtgcgaaagtgagatataagaggtgtaatttagaagggaatgttcatcaatcatcaccatcttttgctttacctgcctactttcttttttgaaagagagagaaacatcttgtgtttgtgtacttatcttcgtggtacaaacggacatgcaatatataatgctttatactattactgttttttatttattacgttttaatttaaaaataaactagatgataaatatttagaaatagagctaatgtttatataataaagtttgaaatatggagtgagagagataggctggtggagtagtcgtcgccacatcccgcttcccccgtacgccgtacccccgcagctcgctctcgccttctcctccggttcctgctgcaacctgcactccgtagtccgccctttctgcccgccgccggccacttcaagactactccccgccgcgttacctcctcctcgtcctcctggggttacccagctctgttcccctttcagggaacgccttgagaggcggggcgggtccttggtccggaggcgcggcgacggcgagtgatttttgttcgccagagggagagttttttttttcaccgggtttggtgggaagtaaggaggcggccgcgagtggcgagacgttcacgggttagatctggcggtacggcgtcgcggatctgagcgaggtaggctgtcgtttccccccctccggcgcctgttgcatttcccccctccggcgcgtgtctcgatatccttgcagttccctgtagttggcaagagctgaaggctacctaatctccatctgcaggtttcggtggagcgatcaggaggtggtcactatcttcgcctcatttcgagtagtttgggcgcctgtagtttgcctgtttccttttcggtgtctgatcaagaagatgatgtgctcagagggcttctagttgttgctgatatcttgtcttgtgttgtatcacccggaagctggaaaggagcgcatcactcctgctctccccttttactccttggttacttggtatttcttggatatccaggctggaaggggttagatccagttcctgcggccctagtaataaggtgcacttggggaaggtgcc

SEQ ID NO: 12533 - DNA, 248 bp, Zea mays
ctcgttctatataaattttggatattcatggtcaaagttaaaaaatatttgacttaggacaaatatagatatacctgcattgttattttagtgagtcctatagttctcctccccaaactttgctatcaacatctaacagttaatccagttttcatgaataaatgtagtttcaatcgttctgtgttgtttaataatgttttatggatcgcatgctatgtccttaactaatacctacatatgcgctgacc

SEQ ID NO: 12534 - DNA, 1500 bp, Zea mays
aatcctatgactcattttttttcattcaacagtgttcacataagatcaaaccgaagggaaaaaccaacaattaagaaaaaaaaatcatgtagtatagactccatggccgatagggagtgactagtgagagaaaaagaatagcttttttatggaagactagagagggaagaaagttgaaaaaatgtgaaacgcacaggacacagggccacaggcagtcaggcacatcagtagcagtagagagctgtagccagggcgcaggggactactagagccatttattaaagagccatcgtctgcacaaacgatcctccatccaagtctttcttcccatcccttcctctcctcggtcaaaccgcctttctctcccctactcttctccctccctccccgtctctctctctctctaaaaaaagtggcgcccggagaaccgagaggccggagaaagaaaggcggaaagagggagcaaaatctcactttgctgggagttctttcctctgtttccgactcctttgttctcttaagtgttcttggttagtggaatggaagctcagcagccccatttatgcccccgagagcctcgtcgttcccctcgtgtgtaggtgtagcctttcactcggttggtggaagggcgaggcacacaagaaaattgatagaggaggaatccccattttcagctcttcgtgttttttgtaggaggaattcccgttcacatgatccgtgcctgtacctgacgggccttgtcgcgctctgctgcttcgctttcggggagaggaggactcgactcaaatcacttggtagcggagacgtcgccctttctagttcaggtgccagttgcaagtcctctcctgctctactttgatgactgtaccttttcttgcatctgtgtgtttatgacgattgacgaaggcggttaggttggcatagaattttgccttcttttttcagagtagttgaggtttgatgagatcgtctcggggatcgcaaagttcgcgtctttagattctatttttctcattttagttgcggcgattcagtgcttttttgaggggaaagatttccgcttggtttgatatttacttgcttgggctgtaacttgggttcttcattctgcatgcgaatgtgttttgggtcacacattaacgaattttccggggaaaaaaactgtgaaggttgcatttttttagttgatttgcaactgttcaactcctgcatttgactgttgtcatctcaattattttagtcgacgtttgtttactggtgttcagttgctatgtgtgctattgaccatatataattgatttgtttttctttgttctgacttttggctaatttcttctgccatatgatcctgattggttttaagctttgttttcctcgctatgtaaagagaaaaagaaaatgatttttgctcaattttactaccggaaaacctaatgtttcaacatcactaatgtgatacgtattacatggcgctcgtttcagtcgagagatatttctggc

SEQ ID NO: 12535 - DNA, 67 bp, Zea mays
ggtatatagttcttttttatcacatagctatatcgtttgacatgcctaactccatgattctcctttg

SEQ ID NO: 12536 - DNA, 141 bp, Zea mays
ctattaataatcatcatcgtctccaatccagagagccgtaccaatccccatcgccccagaccacagcgcgacagtgagtacagcagcagcagctgagagcgtgagagcgtgcgaagcaggagggaggacaagaagaagccg

SEQ ID NO: 12537 - DNA, 247 bp, Zea mays
atccacgatccaaggagcctttgacgagagctgtaagctgactcttcgtgctagggcagctaatagattcgaatgcttgttttgatacaaattatgagtactgacgaaccgtaaactgatgtagtttgtgtggccctcaaagcatctatgtcctgacttgtgtggtttaggtttcctttggcacagtttctaagagctgattgtctatgaatctaatatgagttttgtcaattagagagaagttgct

SEQ ID NO: 12538 - DNA, 853 bp, Zea mays
catttcaaacatccgactttaatccgaaacgaacaaacttaatttttgactaactctaaatttatcctacaacatatagtagtgcaacataaaatattaatatgaactcaaaagcctctttcaaagtaagtgtctgttgacacaggtttttatgctcatacaattgttggcagacatgtatattattcatttctagacatagagagtgtgtgacctttctttggagaccatacatgctgcctttttttctaagtaaagaaaagaaaagaaactgtacatgccctgcccttccggcctcctgttttttttctttcttagaactgtacatggtctacacaattcctcctcgcctattcaacaggtattgatccttgatggagacgacgaagcaagcaggcttgtgagagggctctctcgatcgtgggagaaggcaggcccaccggcagctgatgacccacactgacagtggacagccagggagacatcccacatggatggatgggcgatccaattcctgcaagcatcagcagcaggcaggcaaaggaggacgatgaacagtgatggagatggctagatagcgccattggagaggcaggcagacaagcgcacctgccctgcccggcactgtactgtgctgtgctgtgcacaaagaaaatgaatacaatgtgtcctgctgcgcctcccctatcactggcactgccctgtttgtttgctttttaatgcccggccaggccgccgcactcatctccttcctccatccgaaaccaactgacatcgccccgcagccaagaagctcggctcagctcagctcagttggttcctccattttgagtggaggactgactgtctcgcg

SEQ ID NO: 12539 - DNA, 850 bp, Zea mays
tgcagacctgctctctcgcgcgcatctcccgtgcccctcactgtttagtggcgacgactgggcgacagtcgccgccgccgcccgctaggggccgtgcccctggtctccatcttcgggcgcttcgcccaccaggtacgccagcccaccctgcctcttccgttccgcctgatcgaaaccgagcgctcagaaaaccctagctcaagctattcgagttcagatctgatcccatccgattgcaagtggattatcccagcaggctacagacgcgtattttatttttcacccatgatgcttttcgtttatggaacaatttacctgggtccgcccttcctgatatatccagcctgtatgtactatgtaatttcattcactctctaatgtggtaaagccaaggttcgtcgtaattgcttagcctatgttatcttgccccctgtggacatgattcattttgtagccattgtcttgtcctctgaaacattttgttatttgcatttttggggaaattgaaacctctccctagtctctacatatatgttttttctttgtatatgcttatcaatcagtgtatcacttacccgtgaaacataggtgctcgctgttgcacaaatcagcctgcttttctttggcattgtcttgcaaatatccacatttgcaacatttgaacccttttatattgatggcatgcaattcgttgtttccttggttctcattttctgtcttttgtatttgcctaattcatccggtcccattttttactgtagatatgagcagctggcaattcgattttgaggccattatttgataacccgggacaagtgcactggttacctgaccattttagctttttgag

SEQ ID NO: 12540 - DNA, 383 bp, Zea mays
tagatgggtttaaatttcaaaataagtcaattttttttatttttttttcaattccattcaatctattgttacagggattaaccgacaaagacctagcgggattggtttctgctgggatttttcgtaaatttcccatttttggtcactgaaattgatacacgttcatttttggtcactgaaatttggagcgggccagatacgtgcttcgcggccttggcccaacagcccaacttctcgtcgtgccgttcccatctttcctttcctcttcccttccccgtcgatctcgtcggcgacgccactacctctcgccgtccggtgctaccatccgcctccgactcctgcgacccagccacggatcccgaggatacgggccgagtccggcg

SEQ ID NO: 12541 - DNA, 193 bp, Zea mays
tgctgatagatatagatagatagttaaactatctgactatgtatccatattgatagatagacaaatagatagtcgtctactttggagtatatgtatatataacacataaggtgaagagatcgatatcatagtatcatacacattgttcagacaaacacgccatttgtattattattagctcttatccatcaca

SEQ ID NO: 12542 - DNA, 125 bp, Zea mays
gtcgttatcatctaataattgttcaagctcatatctcacctggcaaatagagaacagtttgtgattcctatcacaagaaaaacggaagaactgatccacaaattctacatgtctctctatgtttc

SEQ ID NO: 12543 - DNA, 1048 bp, Zea mays
cctctagtaccggctcctcggtgaccagctctgataccatgtagaaattttggaaagcctcactttattgttcccagatacaacacatatatatacaagatgggcaaggccaacacgaccaattcctctaccccgcttcttcccctgatctttattttccctcttcccaccgggttcccctttcttgcttggccgagatagaaccagcgatggcccaacaagatttatgaattatttcaccgtaattgatgaaaaatcgagttttggatcttgtcaaataactcatcatgaaggatcaaggaacaactcaatgcaacccagattatgtgctttcgatgtattccaactcctggtgattgatctaaagagaagtaacttaggaattaggaatgttaaacctttacatgcaaaccaagtctgtcacatgctagctgaagactaataaaaaattgtaagttctagaagagatttcagattttttgcttgtggcattaccttacagaccaggcgaatccacattgttataacttagggctacaatccttgcacagaaatttgtgaaattacaattgaaggaatagaaacaacatcaccaatttggcaagcacaagcagtacaattaagagcagtaaaccttcaggaattaagaaatagaccatcaacttatatcgcctcatggaatgcatagactgcactacaaaaatatttttggcagcttgtagttttgaactgctaggtagtagttgagacttgagagcaacaacattcaaacagaccactgaattgtataaccttagtatataacttcaagagacaagaatgcagtttgtttgaacaaacaatgaagcagcagaaaagtgttttgctacatctcaaattatgcatttggaaagaccctttgaatctgtatgactatacatggtttttttacttcccggatatggtacccatcaaatgaatcaatcaaataggaactcaaaatttggaaattaatgaagtaacggattctagctacatcaagtgttgctcgttaaaattttgtagtgtt

SEQ ID NO: 12544 - DNA, 1500 bp, Zea mays
ttgacatgctttgttcacatcgttattcttgtatcagttactatcgaggaactaaccgcaatggcttagatctagctggtagagtcatcaatccgaacttctgaaggaacaaagatcggtcaaaaactaatcatgttggtactgaaaattgggatgaagtatgaacagcttgtgcggaacgttttttgagtggattgactgaaatgaatatacaagacatgtatgagcatgtttgattacctatctttagtgggagatggctctagtgtttactgataactctcgacgagtttccactgtctctacactcacatgttattccctccatttatttttaattgtcgctagataatttaattttacactatccagcgacatctaaaacgaaacggaggaagtacttcatcgatgttataagttgttccgaattccgatctttatacatatatttaggtgtaaagtaaaaaaattatatccacaaaatctaaataatttatacattagaagcatgaggagtactatttatggccattacttatgttttttaaagtgaaaagatgcaaattgagctagatcctcgatcggggatagggatgtcaattgagcggatatgatacagatacatggttcgcgaatccatacctgcaagataaaactcaatccatatcggtacccatatagttttgtgggtatgaatctgtacccgtacccatcgggtatccgctacccgacagatatctgttacccgtcagcgcctactacaatagtagcattcaacagcaaacaacatttttgttacatttcaaaaaaaaaaacattccagcaacatataaaaataaaaaatttggaaatttagggtaatgtattgaattaggatgacccatatgttagatacctaccgggtaacaagtatgaatactggatatccatacccgctaaaaaaattatccacgaatatattacgatagaggttgttgtggctcacatgttagttatcgagaaaggagagagaagggtggacgggtctagtggaccacaagaattaatatgtgagccacatcaactcgttatgatgtaatataaacatgaacatagagtgaactcttaacagatatattttaaaagtttatgtaccgaatatacacaattaaacaagtttaacgattggaagtgcactttatttatgaaaaaaaacttgtgaaggaaaaaaggccaacttccatccaaatatgaaacctgaaaactgataaaaataatcggccgttcagagacaatccaacggcttgccctcgttctttaaaatccgtgttcaccattctccccctaataaatcacacaggtctccggcgaagtctcctcccgaccgccctccgcatctcgtcgacgacgaaaggaaaacctcacaaatcctctggatgcggggtctagccgcctccgccctgtagcaccagtcggatcgaagaagcacaagcgcttcgggtcggcgcgcacctctccctc

SEQ ID NO: 12545 - DNA, 212 bp, Zea mays
ctgaattgatgccggagcgtggatgtgaagacgtttcatttggatatgatccagcaatggattataatagtcagatcagagtcaatctgccaccatggttgaagatgcacatatggaagatgcattgttgagcactgtggatgaaataaagaagccagagaaagacaagaagctaagaagttcacaggagagtttggataaacgtagaaaag

SEQ ID NO: 12546 - DNA, 228 bp, Zea mays
agtgagaatatggggaccaagtgaccaactgaatcctgcttccccagacatagtttaatgcataagttaactgcaaggaactttgaggagtttgcttacttagtcaattttgttctgaccaaaattgtttaatgcataagcctaccttacagagctctgttaaacataaactatattaatgtctgttgataatacacaagcataacctcatattttctgtatttttag

SEQ ID NO: 12547 - DNA, 406 bp, Zea mays
gactcactttttcataatacatttccttaattatggcttctgtgcggatcaaattatctttaagtttaccatgcagtgaaaacttaaataatgtatgctgttttgatttctgagaaatacagatgatatcctggagttgatctgaatatgtttaaccatggttggcactgtccacccaacatatgtggtagctgaatgagtttactatgttctaacatagaaacagaaatttcctaccctttttaggcagcatgaaccgcaagtgtgraacatccattctcatacattttcccaatgaaccaatgcagtgatgagatagttttgattctcatagttctcatcgttactatagtttccatcaagaatttttccaagaattgtcaccatctatggctaattcttgctg

SEQ ID NO: 12548 - DNA, 575 bp, Zea mays
ctcaagagccatgtattctcatcttctgtcggatttcagagaaaagctggtatcagctgcttgagggatgtaaggataatactacttgttttttgttacgacatattgatgttcttattactcaaattatgttgtgttatgttgagtaatcatgtgttttagttatatttctccttcagttttatgttgaactaaggacacgagtttagaagtccccctactaattattccctgtagctgtagcgttagcaagcgcatttgaaatggactaacaaaaagaagaagaaaaaacagaccgctgaaagacaaagcccatgaaacgtgtgacccacagatccaatacccaaccctaaaaacggcccaacgaaaatacagcccaaactcgccaaaatttaaatcatcccactcattacccatttaccctcgcgcggtcgcccctcatcatcttcaacgtctctccagctcgtcttcgccttctctccctcttgaatccctcaccggcggcgatttaggggtttcccaccggtaccgatccccagcgactccggccggccgcaggactcctcgctgcgcct

SEQ ID NO: 12549 - DNA, 487 bp, Zea mays
ggtcagtgacgtcagccagtggtcacaaacagaagcgagcaactgaccgaccaacccccacgatcagaaggatccggagttccggacgggcggacggccactgcaacgagctcgcctgtcgcctcgccccggcgccccgcgacaacgagacctcctcctccgctcagccgcagaagccacctcgccgccggcaggttcaccaacaccaacctccctagtcccccctacctctcctcactcaactggccgaccgcttttccgaacccgtgccgcccgccagtaactgttccatctttggcgcgcgcgcgtgcctggccgcctgccaccgccaccacccaacaccaccacacgcgcagctcatgtggcgtggcgcagtcgcgcagaggtcgaccgctctgcagtgcagagaggtggaggtggcgcatgcctatgccttactgagctgcggcctgcggtctcctgcagattcccccgcgcccaccgcgcc

SEQ ID NO: 12550 - DNA, 857 bp, Zea mays
atgtataaaatatgaaatggtggtttcccttttgcactaaatgccacgaaacaccatctattgattccacgaggtaccaatgctccgaatgcaactggataggacacaaaattaggtacattctacacctctatctcatcatattttttacaattttgtacatactatcatataagatataaagtaggtttcatcacctcagatgaacacacaataccatgactctagcaaaatactcccatattttgcttgaagatttactgacaattaatatagaaaaagtcatggaattggatgtacccatgtaagtttttctcctaacaaaaaaacacttaaattccatttatggtgcaactttctaactcactattgaattgtgttgcagtttgctaaatatattgcattttcagaagatgacaatagtgtgtaagcatatttgcattaccattttgttcatctcactgttatgtgcttctactatatactcttatttgataccattcatttttttctgttacaaaagcgtaaatcaatagcaaaagaactcaaaaatagatgttgaatcttcacatgaggtatgctttatgaacttaacacaacaagtttatgttccaccacacttaactattcaattaaaccacacctcagagcacaaatgttttaccatctaatactcttgaaaatccccccatcacattagaaacgccaacgaaaaggttcttacaactctttttttcactttttaactttaaacatttactttaccaattaccatgacaaatattgttccttaatacattcctcatgaaagaaatattgtcacaggctcaagcaaatctctggaacacaacttcctc

SEQ ID NO: 12551 - DNA, 567 bp, Zea mays
aaagacacgatgcggcggccgcctgtgcatgcactgaggatgagcgcgctgctgctgctcctctgcctgtgcgcgttccccgccccggcgcggttgtagaacacgaccacgaccaaatttattcaactagatggagccgaaggttgaaggtacgactggtgataaaaccatatatgatttgtgcatgaatatgtgcatcagcttgaccaacataagataagttagaaatttaactatctgcgtgtggttattaatgtcttagaaattttaactctcgtggcaacgcacgagcacatatctagttaacttatataattgttgcaaatcgaactactataaacttaattaaatttataaaaagacaccgaattgtttgtaggttcaagcagcctcgcacggtcacacacactttgcacgcttgtctcacgtgttgaggagccaaccggctgtccggccatgtcgtcgccggctgcaggcacggcagcggagcagcacctcgcgtaggactgcgtcgccttcgtgcagctgctgagcgacggcacagtgaggcggtccacggactactcc

SEQ ID NO: 12552 - DNA, 1500 bp, Zea mays
agcacgagacccacgaccccggcacgaagcccgttgtttggacccggtccgagcccggcacggcccggttctatgcgaggcccgggccggcccgggccggcccggcacgaataagcgggccgggctcggacaagaaactaggcacggtgggctagcccggcacggcccgtttagctctaagcccgttaagcccgcttttttatactaaaacgtgcttaccggcccgcatagcccgctttttcgggctaaacgggccggcccggcccgtttaggcccgttgcgggccgggctcggacaggaaattgagcccgcgtgcctagacggcccggcccggttttctaaccgtgtctggcgggtcaagcccaaaacgggccgggcttcaccgggcccgggccggaccggaccgggcggtccatctggacatctctatatgtcatagggttatgggcaccagggctagtgtcgttcaatacatatcacacaatatactttgtgtgcgcatgtatgtcgatgaacatatcgtatagtgctctcatacaacatcatgcttgttaggcgtgtaattatcgcatatcacacaattaatgtgttatagctaaggtgttgtttggttcacgaaatataacgtaaagggtaatggtaatggaatggtttacactcgattactggcggtaacaagtttgaatagtccggtatcaatttttagtatggtatttgattatggttagactaaaacaaacatgatttaacgttgtcacttacccattacgttacaaatatgtgaaccaaacgctaccatagttaaatatggatcagatcttgaactctcctggatgtatcgaattcatgtatcgaattttaatacggatacacccgcactgagaatacattgcgtgccaaacccgtgggtacctagcaactagccattaccactgcctcgtgccgtcgtgcgtgcaggtgcagcttgccaaacccgtgcgtaccagcacaaaaccaccagcgcggggctccgctccgctgccgcagttttgaccacagtttttttgtacgcaacgcaacaggtttttttttttgcgtcgccgataccaccacctctcatctcctgcgcgccgcaactacgtggtcatgcctgttgcgcggtggtggcacacaacaaaactcgatggatccatcccgccgccacacgcccgtttccttcccttttcccgcagtccggatccagtccacggcccacgggttgctggctgcctggcttccgggccccaccaccaccacagcgaccgcgggacgcgggtgccgcgtgctcgctttcacgagcacgacgagctcggcttcggcgtgagccagcgtcgtacggctcatccgccccgtcctcggtcgctatttctctgattctctccatttcccttgctccctaccgtcgcggaggaagacaagacgcgcgcgcagaagcacacctgctcgggctacattaggaggacagcttcttcggccggcgac

SEQ ID NO: 12553 - DNA, 1500 bp, Zea mays
atcacatattctattatttctctctcctgagcagactcccttgcccgccttcggccccacctcgggaccccacctctggcctgtccagttgcacggctgggaaccctgaaaatagcgttcacgtgctctctctctctgctttagagtagacgatagagcggctcgctgcactaagtttttactgcatacatcacttaatatggatagcgttcctttccagtatccgactgcggccagcytaacaaccttcctgtggcaaagtcttcttttcagctggtattatctcgaacacctcaatggcattaataatggcatgggttcctttcacaggttacaaaatgatttttaatgttgctctactgacagcaacagttttattcaggacaagagcagtaaaacgctctcctgtcacgcgaactatatcaacatccttaaaagcagtgtctccgttaatgagtacattgaatacgctttgttcttctgcagttaccgcattatcgatctctgcaaagtgaagccatactgaacagttcttgttcggagtaacgtccatttcaaaagacccatgatagctgattggtatatgctttgagggtaaaaattataggcgttgtcatctatttgtagaacttcaatagaaagaaccgatggatcaccatgccatgtgctatggaagcaaacggataagcttgagtcctggacaaaaaccaaagcttccgcaaacgtcttctctcatcgtcgctgctccagcccagaagcaaagaactgaacagggtaccctcaacagaaacatcgaaaatcggtttggtgtcaagattagggttgtctagtaatgcaaagaaaagcctaacttgatagtggccattggcaacgttgttgatgtagtagcaattttcagggccatcagatagcgggaaatatcgaagcgttttcaggggaggaatgataaaactcggacgagtggcgcctccgaatctgccactgaaaataaccgtttattttcggcgcgatcttaatctagccgtcgaaaataattgaggccgtcgaaaatgagcagcttagctgttgtgaaaacaggacatttccattatctaaaaataatccatgtgtgtgcagtgtggttgtagctacaacagcgctttctcaagtgaccctcctatctaggctatctgttctcttgattctacggactttgtagatacttaccaaacgcccctgtatacaatactctgacatttagttaggggacgataaagtaggcggtacagtccgtccgatccgacgtagacgttacagctgctcttacctaccatagggccagacttgatttctttattagcctctctgtttttgtttttgtttttttgttgacgttacagctgcagccctgctcttacctaccaaagccgctccaatgatgaactcgcttgtatcattacttcgttagccacttccctcacacatcctgtttcttgccgcactagaaacgtcgatccagca

SEQ ID NO: 12554 - DNA, 1114 bp, Zea mays
agcctcttattcatttttgctagaatagggtccgaaatagcagggttcagatgatggtgagaaatggccacacacctaggttgcggcgtttgtgtgggagctgttggagagggacttgctgatcacgttcggtgagggcaattaaggtatcgtagacatgttctacacggcagccatgtgcgggagcgtggacgtgttcactctactgctcaaccacgccacgacttgccggaacggccaaggcagcgcaaggcgtagtagctccatgttctgtacactgagataatgagtcgagtcgtccacgctgcagcgagaggcgggatcgtggagatgcatagggagttgctcgaggagagacagacgttcaggctattgctcgaccatgcatgtcacgaggtgttcgacgaattgcaagtcacgctacactgcctgcggtgccgagtgccgactgagcaatacgagctactggcacccagcttgcgatttgaaagatgcacactaacaccaaacagcgaaacacccatggttcacacgctcctcctaccacgtccacgacgaaaactgcattgtgtagccacgtaggaccaaaacgagggagacagaggaagcacatgcagcgttttcccgaaagacacgtaagcagaacgtctccgctccgaggacgacacccgctcacgagcaatccggcagccagccgccgcaccgcagaatcttccccacgccacgctgccactgaaagcgcttcgacctcgtccgtccgttcgctcgctcgcggcgaaccccgcagagcttcccgtgcacgctcgcccgttccgttctgtgtggttggcagcctggcagcaccccacctgtccactcccctccactacgatacgagaccccggatccgtttttgctgtgtgctctaatcaaaaatcaaacaaaccagaagctcctcctcgcctcccatcacttcctacgccacccgcgaagcgcgcccgaggcggcaccccaccgtcgtagtagaagacacgggacgcacccccgcagcctcgctcgctcgctcccctcacttcctccccgcgcgatccacggcccccgccccccgcgctcctgtctgctctccctctccgca

SEQ ID NO: 12555 - DNA, 1500 bp, Zea mays
aaaacatatggagccccacatttcgggtattgtcaagttgtgcgtttcactttcaaaatagtgtaagggccttgtgttttttttcttcttctgaatttgttgtaaaatagtctagcatcccttgcaaagagggggtaatgttgttgtcacatgatggtgtgtaccaaagtgtagtaaagcatcccttgcaaagagggggtggtagtgtcctgtatgtttttttaagcaaatgtgacaaactatataagaaatgaatatttcatgtgagttatgtatttccagccgtattatttaggttacttgcattcatatttaagcagcttacaaggaatgcacgttactctgagatcagaatcatttaagtgtccatctaccctttccttgcttacagggcaccccatctcttggtgactgtcgttcgctacaggatgacggcaaagctttatttagcgctggtcggtgtcagtgtcactcatatggttgttagagctcatgctcagggatttctgaatgctgaggccttggatcttctcgctcccaaggccacgggcaggaaatcacaaacgggagaagttctatggtgtaacacccttgtacttgcacagttttacagcaaatcaaatgatagcagagtagcaggaagtaccatgttttaattcctctttctgatcaatggacttttaggaccaatttggaggcaaaaccagagagtttctctcccatcaagaattaaatgccttgtacaaatgacaccccacgcaaagatcacaagggaatttaagtttcaaactagcccttaggggatttctcaaataaagctatgctgcccattctgagttctgactgcattgtccgagtatttgtacgatgctatctactgtatgcatttttttatctctaatgtataaagcactagatttcaaagttccacctttatcgtaagttccacctttatctgcccttcccatttaaatgataaaaaactaaaattatgtataaatgaggattcaaaccatagttgttgggtttaaacccatgttcacatcttactaacataatttacatgtttttatgttttatatactttgctataaatgagaaaccgatactttactagcttgttgtatcatcatctttacgtagcttttttttttagtaaagacaataactaatatacaatcatatgttatgtgcaagcgtggctaccaacctatagtcttaaaccgtcaacaaatgcagtttggtgatatgagcagcaaacagagattagagaggcagcaaagaaagataacagaagagacagacggaaagaacaccggaggcggagagccacaggaggaggagctcgagggacgacgaccagctgaattaggactggagggggcagacgacgtcgtcgtagcggcagcagcaggagaagggaagactcaaacgagggatctccgagagaggagtgtggtaggcaggaagaaagaataaggcgagccgagagccattcgc

SEQ ID NO: 12556 - DNA, 653 bp, Zea mays
ctcgccccttctcttccttcctgctgttcgaaacccactcactacctcttatgtatgctattcctattcggatctgacacaattacatgtatatacacttcaatttcttctgcaaaaaaactacaaaataaattatcgggtgtatatgtgcgcaccatgtcatacgctggggctgggtccgcccctgcgagcagcagtgtagctgaaacatatcgaaactggtattttggtacactagttgacttgctagtttaattatcttctgattgttagtttcgatgtttgattaatccatgataaatagcatccatgataaatagcgctatggtaggtcctgtggttgggaggctgccgaccagggtccaaatcctggcgtgcacgaaaaaggtccctcgctgtgtaactgtctactgaggtatacgtgctgcaagagcgtcctgtgcagccagttttcagggcctattcccgacctgcagtcgatgaaatttctggctttctgccttcgtgataccaatcccctaggggtcgagttttttttaaagaaattatacataacatctcaaacgtggtactgatctgctgcaggagcaagattgaagccttgaagggctatatagggttgggcacggttgacctgatcgactgaaactgaa

SEQ ID NO: 12557 - DNA, 912 bp, Zea mays
ggtgtggcggctcgtgagcctgatttttgagttcgcattacgaccgagccgagacgagcctgtagaatgtgacgtcgagcaaagggtaaaaaatgagaataaatattttagaggaccaaagtaaaattttataaaaggggttaaatttcaaaaaaaatcggacccacgccaatgctatcgttggacttcgggaagaaatggttacggaatctaaatgcacatttgatcttaccagttaccacgcaggacagtaatgctttcccaaccacatgctaggaggcagaaaattctcgtcggtgtatggctacagcctacaggacactgccgaagacctggacgactgaagaccaacaagacgagcggagctgtttgtgcccggcgcgctcccactgtccggtcaggtaccaccccaccacgcgaatacccggtcctgacccgcctgacccacttccccgcctcccgcgtcccggcgttaaaaacgcacgcgccccgcccagtcagtcattagtgcgccgcggccgcgggctcccgtctcccccctcctgccgcttttcgggatttcgtttcgtttcactcgagggcgaggctggatttgcgcgtcctgtaccgagcgttccatgtgacaggtcgctcgcttgcccccgccccgccgctccccctcctcgtctcgcaaagcaaccgcaacgcgccgagccggcagcggggtccccccaaaagacgaggcagcgagcaaggtaggcaggcaggcaggcagcgggctggcggaaaagactagtgcgcgctcgtgctcgtgctggtgctccccgaccagactagaccagcttgctagcgccagcaaggcgagcggcgatgctcgcacgatctactacagctgccgccgcggccgccgccgggatctgcctgtgattaagg

SEQ ID NO: 12558 - DNA, 533 bp, Zea mays
agtaggactttacttcacccagtaatcagctgagcagaaagcctccagagcttccacaggataaggatcgggccatacaagattcttttgacaggataaagtccattgagtttgatctggagaagacaaagaaggtacctgccatgttttatggatgtcatgctgtttagaattgctttggcttttgcctttatggctcgagtgccatgataccttttatatcatttctttttactaaacaaaatatttatttcactctcaggcaatgtaagttcaccttatatatggagttaggtttaactaatattttaaaaatgacaagtttgtgatgttaaaattacacattgaaggccaaaacattgccactcgttgagtcattgttcaaaagaactacagggaccatcatctgatgtaagcttgtgattttgctgggtaatcccttaaccgttgtcaggtggatatatctttaggacaactttgtggggacccacaggtctatatttggtcgataccttcttaaaacacatcttttg

SEQ ID NO: 12559 - DNA, 155 bp, Zea mays
ctttaactccactttcccactagcagctagggtttctcccctcttcttttcccctcctcccgctgccctcggctcccacgacgcccggctagggttttgcctccttcccgctgccgccgtctcagcgagcgagactgagctgtgcttagtaagcc

SEQ ID NO: 12560 - DNA, 75 bp, Zea mays
tgcctgcaggccgcggccgcggccgccggccgggtcgccgcgggcggggcggcgctctacccgcgcgccaacccg

SEQ ID NO: 12561 - DNA, 1469 bp, Zea mays
ggagccaacaactaagatttaaacattcacttgcgcacaattttaatttctatgttacttttagataaagcgagaagaagaaaggtgacacacagagactgtgaaattgtggagccaacaactaagatttaaaccttcacttgtacataattttaatttctacgttttttggataaagtggaaaggagaaggttgacatgcaagattgtggaatgctggaaccatatacattgatgctttatatagtataaatttatagaaaatactattatgctccgtttgttttgttagaattgaattccattttaataattataatttagacaaaactaattaagttcatatatttatatatgtaatatatttgtatattatcctaaatcatatgagagatagttatatactacatttatgttataacgaagcaagtagaagagtatgttataggttgtgcatcggaaaaatagcatgtaaatctatagaatcaatttctatctcttacctcatgaatttgagataggcttatatgataattgtgaaaagtggtggaatgtcacattctaaaaaatatattattttattagtgggattccaattcctcaaaatgaaaggaaacaaacgagaccttatttaaatatataaatcaaattactatctttggtacaattaatctaataatatctatttgatgttataagtataatttctatatatttgccaaagtttatggatgcttgatctattgaagcgtggcatttattttgggtccgagagactattttaagctgagtcgcaggtgatatttatttagatcatctataacaacaacaaggatgcctaaaaaataaaataccccataatttaaaatgtttaatccactaaaaataaattgagctttggtagttagccctaaatcatgtattttaagaaataaattatattattaggaaagaaaggttaaagatgatataaaaaagaaggatatgaggtgtagtataaattttcactacattgtgtctcatatgccttctttaataaaaactataaaataagaattgtttaagctgttttttatgagtctagagatttgttgtaggacgaaacgagttctttgtcctgggcctttgtcactcttctctgtgtaacgacttcctccctttcctgccgcaccacgcaatcaccggggcggaggcggctgccggcgagcacttgggcgtctccggccaccgcctgcctcgttgtggttagtttccctcaccttccccttacctcactgccatattccttctcccgatccgtcagtttcgccagctgaagacgatcccaatctcagatccaactaggaactcacccagcgctatctcccggcaggctccccgttgactcccgcgatttgttacccgctggcgctgccgcacacagctcaaaaggagtagcagcgcccctggttgccggttggagcgtcaagg

SEQ ID NO: 12562 - DNA, 1019 bp, Zea mays
gccatcatggaccgtctgaaccctaggcgcggaccgttcagacgtacgcagcgaaggagccgctcctgcgtctaggtcgcggaccgtccggctcagggccacggaccgtccacgcctccacagagcaccgtcagacagttcatctcccggtgtttagcacccaggttgacgccaacacaagggttgctttcaacccctcttgagtgatcacatgatcgaacttgagtaccacagtcttccttatcgatatgtatccctttggcaagaaatcttcacaaattgaagtcttttgcagagtcgtacacgaatccaagttacaatctcgagcacaagaaaggaggagagactacaaatacaaaagcaaacgccataatacaacgttataaaaaaaagatcacaagagcgcaaacacaaatgtctaaagaaaacggctcaaaaccaggatcgggtctcactagaatcacaaaactgcgttctcacagagtatcggagttgtgtatgctcttggagtgatttgaggctgaaggaggtcgctaaggcgatgacgtcactgacgcgtaaaactccattcccattatcgtccagggtgctgaaccaaacagcagcttagttctggataattgatgacagattagaattttgaatgtcacatttaccagagactaaaaatcacttgtgttcgtcttcaccgcgataataattccatcatgataacaccaacagcgacgtattaacccaacaaaatcctccctgcagataaacaccccctctccttctctatctcctacagccaaatccccaactcttccaaccgctcctccgcttagcgtgcagatctaacgatcgctccgatcccaagcacaacaacttctccaattccaatcaccagccgatcagatttatgcagtcttactgccgcgagcgccagtcatgccgcgcggcagcagcttggaccagagcttgagcgacgacgagggctcggcaggtgttggggcggtttgggttcggcgtcgctggca

SEQ ID NO: 12563 - DNA, 1500 bp, Zea mays
actacacaaccgtctcagtgtctgtctggagtcagtcttttttaccattggccggtgatcatcgtcagtagtgctctgctgccgctagtatcactgcatatcaggctggctgttatcatctggcaagccatgaagtgacaatcttactgacagctctctttctttcttgttttctcggtactaatccatttcacacagatcttgcagcatcgagcaatacaatctacaccgacaagtgtcaaacaagtactagcatgacttgactaatggtggactaaagtggctcggctagccggtcgtacatgtgttttcttcactaccaatccaatctggaactggtagtagcaacgtcaacgactcaatttagagacgactcctcctagtgccactgaaaacctcacaattcacacgactcctaaccacacatcacttccacgtgggctcacgcgcgccgggcccccaccagccagcgtcccaaacccgcgtgtccgcgcacgccgccaaaagcagtcgcgcccaggctagcactagcgcggcgccgggccaggccaacccacgtgccgcccccgcgggccactcgccgctgggcccagggccctccaccccaaccccacaccaccacccaccggacgcgtcggtcggccccacgtggagggtacacgccgtgtcgggcggcgtggacctggtggggcccagcggtgagcggaacgcacacgccgctcccctcctccctcctttctcctctgctgtgctgcctgccccgctcgccttttttttggttgccccgcgttgttttgcgcataggaccctgtgctttttccatatacttcggtaatggagcggttccagatggtcgtcggtcaacttttccatccccagcctccctgctgcaggcgccggtgaatggatggaccgagctcggactcgattctttttaccggcaggtcaattggtaccgacaagcccacaccagaaatgttcagggtgtaatctgcaaacaaaaagacaagacatgtcctttccttaatccctactcgcttccagactgccccctcctcgagccctcgcccgcgttcgcccccggctgggatcaccgcgcgtttgccggcgccatggccgtcgcagtcgccgtcgccagccaaaatccactagcagcgcgtaacctcctgccgatctaggttggtgcgcgctaccgcttccctccccttctgctccccgtcgacgccatctcctcagccccagattgcatctccctcttcttcctctggttctttcggcccgggcagaatgcctcttttttttcttcttcttcttactcgcaggctgcgggcttatgctcgaaggcgcgatctttacgctcggagtggcttcgtttcaggagacgggggatttcttctcgcccttttcctcgccttgcggctgcggaataccggggccggcctggatttgctcgagagtgagaggaaggcgtaacagtgtgaaggaggcgcgggggacaat

SEQ ID NO: 12564 - DNA, 1500 bp, Zea mays
ataaaacataataataaaaggggccttcattctacttgctaaagtggtatttctcccatgaaccatataattagatttctcccatgaaccatataattagaactactttaacaaaatatttaaagatatgtgttaagttcctccaaagtaaagaattcatggtaaggaatatatactaactcttccacaataaataggaatagaaaatttatatgttcaaaagggatatactttctaataaaagattaaacataaaggtttccaatttatttggtgaatgcactaactttataaaaagaagttatctgaataagtaaaataactgatataaaatttaatatcttgcatgacatgctcttttgattgttgcatttgaattgtgtgaatcaacactaaaacttagattgaaaacaaatttgaaattgaatagggaatacaaataggaaactaaaatagaaatagaagaaaaagaaaagagttacctgggccaaaaccttaatctcagcccaatcaaatctcagcaccgtgccacccatccacccaagtgctgccacgtcgacatgtgggccccactggccagcgtgcccaccaattgggggtgtggccaacctagctaactagcacgtgggcccatgttgtcagcctgatcctcttccttcgtccaaaagccgaacagaaccaactagggtgtgcggcgcatccctctttcccggggaaaatcaaaacaaactccagattctgttgaggcagcgaaatgggatatctccgatccaatcatgtggagaaatttggaattttgccattatgaaaactggacttcgctggattgccattaaaattgtgggtttcgttcaagtgccattatcaaccaagacacatacgctgaaatgccttttggctatttaacaaaaagaaaaaccaatttaatcgggttagagagggcgcacggactcatttgcccttctcttctccgtttcgctgctccgctcagccatctggtccaccttcgccgtcgcgcccacggacaccctgctcacgggccaagaccttgttcccggcgtgcagctcttctccagcgtctcgcccaccaacagcgccacggggaggtaccgcctcacgaaccagatcaacgacggcaaccctaaaccctaactaacaaatcgtggcaagaggcagcgaaccaaaacccctgctaggctacttggctcaactcgagttgttagttaggtataatcgagttacatatatttttagtttgtgtaactatagctatgacaaaagatttctctaactatatatattctacttatcaatgacataaaagtgtggcaagttcttatatgtggcaaactggcacagaatttaaaggtttaaccttagacatgtatgatttaaaatatatgataatttttagggaaatttggattcataccattaaaagatcaccactttagattcataccattactatctcacttacatgtgggtccacatgagtca

SEQ ID NO: 12565 - DNA, 624 bp, Zea mays
atttagctagtctcttggaggtgcttttactgtttaaaaataagtaattattatattaaaataaatattttaatatgtatttatatgatataacaaccgtaataaagcatgcacgcaactgactagtttatttattatagagtaaagtttaaaatatagataggaatatacggtggaacaataggagcctcctggtgctcgagttctgatccgagagccatacgccatccagattcaacgaacgccgtcggcytccgctccgtgccacgtcccgtgcaccagccatccccgtgaggccctcacctgcagtgacacggtccaccttggaccaggcgccccgagctgttcctctgcgacagcaaccttgcgtgcataaagccagccaccagccaggcagccgccatctccagcggcttcttccaaagctccaactccgacgagaaccgccactcctcgaaatctcgaaggattttctgcggcgaacccgtacgtttcctatcgctgttctcgcttgttcgctggggaatcaaaccaaatcactgttggtgtttctatcttggatataagttctcatccccttccccccatccgccccttggatttgcagcttcgtgacgtgaccca

SEQ ID NO: 12566 - DNA, 187 bp, Zea mays
aagcgcgttaggggatctcttagatcgtagcttagtcgatgctcagagaggatgagaacagagactttggttatagtagtagtaggcaatcgtcgttagctctagcggtgttctagctcagactgatttgctcggtgtttttagacgtcggattcaatacaatctcgatgttgtcctgaattgtgct

SEQ ID NO: 12567 - DNA, 207 bp, Zea mays
aagcgcgttaggggatctcttagatcgtagcttagtcgatgctcagagaggatgagaacagagactttggttatagtagtagtaggcaatcgtcgttagctctagcggtgttctagctcagactgatttgctcggtgtttttagacgtcggattcaatacaatctcgatgttgtcctgaattgtgctatgggttttcggtccattag

SEQ ID NO: 12568 - DNA, 446 bp, Zea mays
agtgtgttccttctatagttatataatctgaataaattcactacaattggtcccttctaggtgatagttgcatagttaattttccttcagaactcgtagtcctatgcatgtatggtttccatgataacagtgttttaaaggcgtcgcctaggcgtctagacgttcaaacaatccgaggcgccttgctcgcctaggcgctgcctaggcatctaggtggtggacaatttcttgtctcaccataccgccttaagaaccatgctaatctccaaaacatatcgaagaactcaatacttcaatcatctctttgtcctgctggttggcttctccagtgaaggtgtggccaagccgcgcctggttttctagtacaatgttaattccatgttactccgtctggaagcaaactgtcagcttcagttcctccattcaatccaggatcagtgttatca

SEQ ID NO: 12569 - DNA, 1284 bp, Zea mays
gacagctttggccgtcggaagttgtttcgtttactgcagtgcataaatatatttcgcattctagttttcctttatccttcgcgacaaaacctttgacataaggcacatatatacaatttgaaccattttattaaaaaactgccttccatctgatgtagtctaatgaaccaatttttaaccgttttattatgtcggctccattctattagttatatataaagtgcgaaagagagctctaaccttaaacgcggtgcaacgtgagggaaaaagcctctcaacgatgctactgctgtagcgcaccgccacccgatggaacagctcaatcgccccccccatcatgtcgtcgcacgtcaaaagcatggcatggccgaaccgccgcccgaacggagcagggcgacaacaccgtcctcgaaagctagctgacgaggcggggcatcgtcaaggccaccgcgccccgggacctcacaatcacgcgcgcgcgcgcgcgagtggtcactcgtcgccggcctcgcctgtcgccaccttgccgctgcccttctcacgaaagacgcggccgcgttcggcgtaggcgagtgggtgacatagccctgccgtacgcggaagccggaacgaacctgatgtggtcgcgagggcgccgattcgacgtgcacgttaccacgctcgccgcgcgtcactgtctgcatgccagactcccctcccccaccccccgtccctgccgtttctggcgtcccgtcggcgtcggggcgcgacagagctgtgccgaatggccattctcggacgacaggggggtccgatcgagggaggagatgaggtccactcgtcgtcgtcgtcgtcgtcacagatcgcattcatctagacaagcgttccggcactttggcacgcgcctaactcccgtccaccgaatgaatggcccccgggcgatcggcgttcggcgcccaagctgttcctatttatgcttcgctgtgccgtcgggctcgcaagcattctctttcaggttccaggctctgggtcgccggttgtgccgactccgcccccgcgactgctgcgagcatcgcgagttcgagacgaggtatggctcgctccggttctttggccttgtgcatcgtagaactagaaagacatgcgcgctagctagtacaacagtactactactagaagaaacaagctcctcactgtcaacctctgctctgtcgccgtttcttcttcttcttcctgcttatatatgtccgtgatgttaatttcgttccatcttcgcagtttccttcaagcatagagatcagcgcg

SEQ ID NO: 12570 - DNA, 1500 bp, Zea mays
gggttgccgacgaaggatgtggcattgaagtagctgaactgcccagtcgccggcacgagcccggacaggttgttgtaggagaagtccacggccgtgaggctctgcatcgcagcaatggttgccggtatctctccaccgaggtggttccgggacaggttcaggtagttgaggattcgcatgccggagatggccggcggtatctccccggacaggttgttccggctgaggtccaggtaggtgagcaaccggcacttcccgatctctggcggcacaccgccgtcaagcgtgttgccgctcaggtcagccttagacaactgctgcagccgcccgatctccggcggtactgcgccggtgaatgcattctggtcgagaagcagtttttgcaaacctgagaacttcccgatggacgccggcagtgcgccggtgagctggttgttggagagagtgatcgcccccagattcggcgcaccggtgccggaaaccgccgggaagccgccggacaggaggttgtcctgcagctcaacctgcgtcagattcggcagctcaaagagaccatccgggatggaaccgttcaggtagttctcgccgaggcggatgcgggagagtgcctcgcatttccccagtggttcagggattgagccaaagaggaagttgccgagcgcgatgagggtctccagcttgccaccggcgcatagctccggcgggagggtgccggtgagcctgttggacgagaggtcgaccagctggagccgtccattgcggccgagccggcgcgggatgccgccggtgaagttgttctcccagagctgcagcacctcgaggctgggcaggtcgccgacgagctccggtatgctgcctctcagcttgttgcggaagaggttgagcaaagtgaggttcctgagcgccgcgaagctcgctgggatctcgccggtgagcgcgttgttggacaggtcgagcgagctgaggctcttgagccggcccagctccggcgggatggcgccggcgagcccgttcacctgcaggaagagcgtgtcgaggttggcgaggttcccgagctccggcggaatctcgccggagagcccgcagttggcggcgtcgaggcggacgagatccgtcatgttgccgagctccgggggtaggccgctggagtagctgttgtagtagccaatgtagagctccctgagggtggtgaggccgccgagctccggaggaatcctccccgacagctcgttcccggagacggcgaggtactgcagcctccgccagcggccgtactcgggcgggatctcgccggagaagaagttgccgccgaggtggaggtggcggagcaccggcaggcccacgaccgcgagcgggagcgggccggtgaggttgttgttgtagaggtcgagcacgcggagcgcccgcaggcgcgcgagcggcggcgggaaggtgccgttgagcacgttgttggagaggttgaggtgggtgagggactggagccgggacagcggcgccggg

SEQ ID NO: 12571 - DNA, 1164 bp, Zea mays
ttgtttaagtctggtttttccgaagttaatacccctctattctaatttataattcgtttgacttttttactctaagtttgacttactcgtcttattaaaaaaatcataattattattgatttttagtgtgatataagtatggctttgaatttttcattttttcgaataagacgccggtcaaatttggtaccaaaaagtcaaacaaattataaattggaactgagagagtgctatgaattgtaaaagtgcgacacacattgtttaaagtcccaataattcaattttctcaaaattcgtcaattaatcataaacgttttcctacattcaaacacctcagccaatagtttagctattaactatttttagaaaattagctaatagttagtcaactatttatcgactagttaattttactaactttttaggcaactaactattcggtctagtacattcaaacatggcctcagtcaatgggcctccttatctgaaattctcaatcagagcccttggaaaatgacgcccaaatgaaagaacgctagggcagttgcaccagcaccagcggagccgtttgctattttgtcactctcagttgtgggcttctctattttactatcagacccacaaatcaaaataacaaatggctcaatatgcagagcacacggtggactattttacctgaatgactgaaacccgtcagctcctaatgtcctacaggcatctggagctctgaaaaacaacttaattttaccttagttatttgctgtgaccaataatatgtcctcctaactcgatcgcaagctgtaacatggaactctgtggatcctcgcagtgcctgcatgagaccatgtctcctccagtgtgatcactccccaaccattttcgtccacacagatttaaatgaacttccacacgtaagttcctgtgcagaataaaggttcctaaagctactgaaatccttgaccttgtcttgtgccgatcttgttcaccatgttagtactaagaactttacaatgtcactagctgaagattgggcttttgaatggagcgcgagcgacagtgattttccatgaaaccgacatctgaaccaacgacggaggatgctctggcacctccggtcactcaccgtgccattcttcaagcgcgcttcgagcgctgtgcgacagg

SEQ ID NO: 12572 - DNA, 1500 bp, Zea mays
agtcactaaaaaggatgaaaatctgtgaaaatggcagagaaaaccagagaaacgatattgaacagaaaactgagaaaaatcttgaatgcataagatcgaaaagacaaatagaggaagacgagatatatatgctactttctacaacttcgataaaacactgatatgatagacaaatcttcttcaggaaaaaaaactatgaaatgaaatgctcctgcacatctgttcatgcagctagcttacgcacatggatgaaagcatgacgttgaaccttcgtaatattgcatgctgtatatgctgagctgcttgatatgactctgcacgggactcaagaaagatgcgagatagcatttcgaggtctcgagcatcagctaccgttccgcccatgtaccctctatggaacagtaacgaatgaaacagtagcatatagatcagcagctgagggcttcatacagctccagtgactgaacctacagctctagtgactgaaccggtgagctaagcacatcagcttgtttggaagataaaatgagttgacaaaaataaaggagatgaaatatgaagtaaaaaaaaaattgggatattggataactggatatggaatgtggcaacactgtcagtctggcaacaatgctaaaaagggaaggaagaaggtagtaaataatgcactgatgtttttttttactcttgcttcttattgcaagagaacaagttgaaaaactcaaatcttgtttgaggtacaggtctactatacgacaagttcacgagatctaccttggtaaatggaagaactgtatgcatatttagcaattatagacatagttgtgctgaagaaaaaagtttgttttgtggaaacatatccggtgcatattagactttggtgcacatatggtgcacataaactaacaaagtttacaaaaaaatctggaaaaaaatcatacatattctttccattttactccaattatatacaaaatttcaagtttaaattcgttatacttcaactgtaataaaaaagataaaatttctgacaagtttaaattcgaaaatcagctaaaatgttctcttttttattacagctaaaatataacaaatttgaatttgaaattttgtatataatagaagtaggatgaaaaaaacgtatgatttttttgagattttttgtgaaatttgttagttcatgtgcaacacatgtacaccaaatgttcatgtgtatatgatatgtcctccgaattattacttggaggatatttaaataaaaattggtcactatgttattgtatcattcaatatttttttatatgtcgtgagtcagtagttttagaaaaattggcattgacaagctctcttcgtttgggccatcaatacatttctgaagtcgtcctggctcccttgggtcggaaaaggccaaaaactcatcggcaacctccatctraaaattctctcgcctgaacgtccaagcacaatcccgaaccctaaccagcgccccagctcgccgtcggc

SEQ ID NO: 12573 - DNA, 1246 bp, Zea mays
cccctgcaagctgaacatttccagacagtatcatcgtacagctccattgtagcagcacagattacagttcaagcacatatagcataatgctatatcacagtagaagcaaaatcaagctttttcaaaactatcatttaatatgatatatatctaccatgattaatcttttccttcaatagaaaatgctaagaatggcagggagactcttatccaacacttttcgtgctatcttgctcagagtttgacttggacagaaggaccaaggacagccaatgatctaaaaggtaaaacctgatctatttgtactatacaaaacgctggtgcatgactgcatccatctgtattgtatctccaatgcaaagaatcaatgctactccagttttctgatgtacaatttgtattcacttccttcttttagctagggaatgttaagcgacagttcaacctgcaaaggaaacaagaaattttaattaggaaattagaaactcggaagaaattaggcttgaaaccaataacacgacctaactaaagacatgcagacaccggttgaaaaaaatggagttcagcacaacatcaacgctggtgtgatattatttacttgcctgagcttctgaagaaccatctggcatagccatataacgatggcctctcgggtgtcggcgtagcagcctcgaggtcccacctcatagaccatttatcagtttcgctgtgtccacttgatgtcagggtttctttgacatgcctcaaagtcaccatcaaccccatctcagaagaacagctgctggagcacccactccagctgccagaaagcgtggccaaagatcccagccacccgatagacctcctgacttcctctggcacctccttaccatctggaactggcagcggcttctgtaccttagagcaatctgagtcattgccgtggctccaacttccagtggtacgccgtgaggacactggcacaaccgctggagtggcacgattgctggagcatattctccagctgccagataatctgtccagggaagagcgcagccacccatgagatcctccgacagcctctgctactacctcgccaggtgggattggcattagcatctgagactcgatgtcgtattcaactgagcagaaggatggatcaactttagtcttgttacagccaggaatggtgatagaggcacggcaaaacgggcagcatggtggtgtggtgcggcatagccaagtgatgatgcatgactgatgaaac

SEQ ID NO: 12574 - DNA, 1500 bp, Zea mays
gaataattttcctcaaacataaaaataatgtagaagaacttggtttgaaaacaaataaatggagagacatatccagcgatagacattatatcaattaattagacgttcggtcgaaataatgatgatttaacacaagacgacgatcgatgaagtcggtcaattgaagcagttcaaatttgatacaggaggaggctgaacaatcatgttgttgacactctcaaaacatgattatcagttcctcacctaagtaggtcaacgcctggacgacaatcgtttcgtaggtttggtctcctagaacttatgcgtgcaatgaaaatgaaacgaacagtgggttaaagcgaattgagagcatatgacatgaaactcgagctatcacaacaggccaaatggcgggagagccgagagatcaccggagattagaaaagccatcaaacatgctgaaacacctgaacagctgaacttaagttagccttttgaaactgatggctctaactccctagtagcgtcgcctcgtctcgccttggcgatgtcaacacacacacgtagcacgctttgacttttttcaacaaatcaagatagacaaatagagccaaccatataaactatatgattattccatcaactacccacacgatgttagagataagacgtcacttatttaatatatgttttagaattactaaatatttaaatggaccaaacctataacaaataataacaatccctaccaaaatctaaatcatgtattaacaatcgcaaatccacagttttttgatataccatagtttcaatggagatcgttaagttraacatatatctagattctagaacaagcgttacacttgtttataattcttcataattraacaatagactataccttaaattaatagttctgcgtgaagtgagtttcacaaaaaaaaaattattggcgctagtttactagaaatatttactcgagttaaaacatgtaagtcacacttcgaggccttttataagtatctagatattatccaaatctcacactccgtggccaatagccaaactcatatatgtatgttcgttttatgatggtctataggaccacatccttgttagataagccactcaaatcatattaaaatgagtgactctgtaagtaattgaggtttgttcacgtggtttataccaccctgtacgggtaaagtaggtttattcagtttaatgctaaccaatataaattgaacagaattaagtcagtttaaatctatagtaaatcaaaatttagcttaatatattttaatcccctaccattcacgtggaatggaaataaccaaccaaaaccaagccttacgagcacgattaaatattagcatcaaatggagcgacatcaatccggttcgggccccggggcccatgaggagtcgctaggggcttcaacttcatcgctgcccagaagtcgcacgcagcacggcctccgatcgatttcctcttgtccgcgtgtcccagcgaatcgccgtc

SEQ ID NO: 12575 - DNA, 1500 bp, Zea mays
ccttcgtgtgaaacgatgagatggctgggtgtccatggaacagagcagaaggcgcgtggttgcgtgactgaccgcgtcgcgccgcgaggtcgacggaatttaaaggcgatgatagccactgacggtgcccgctagaacgttcccgccagtgccagactcgccaacgacgcatccatcggccatcgccgggctcgccgcgcgcggcacaaacctacggcggctagggctggaaaaaaaaatctaggccttcgagctcgttgtctagcgagtctcgagtgaaccaagccgatgtaggttttcgagcttgttgtctagcgagccgatccagctcgttctagttcatgggctatrttaaattaatcaaactatagaataataatgaatattggacgattttacttataatgttgaagactgattatatttgtcacatttatatattattaaatcactatataatgtaatattatttattaaggtgcagctcgccataactagaccttgagaaccctagaacctcgtctctctataattctaaaatttctcgtctcctttccatcgtgttgccgcccttgcccgtcgccccattccctatttgcttctgcgacgcacccgcaactgaggagtaaccacggtcctcgactttgctcccgcccccgagggttacgcatccttcctcccgtcttttcggaccttaatcctttttagtactttttagtagagtggttatgtagctcattagcagacaccgtaaattggatatgcttttcttagttttgtttgtgcagcaagcagtagtttggttgtagtagtatggatgaaggaggatagggattttgtagaatcatgtgttagtgggactatgcagatgagatagcttggttttacttgacgcatgctatcagtcaggattagtcaaattcacagtactagattgagatgtgtaataatttccctccaacagttatacactagctattttgtctagaaaattttcctcaacacagaccctacaatttcaatgaagtagtaatatgatagttaagtctctggtctagtgggtgtgaggaagccaaatgtttagcttggatgtaaattccttgtggactcctttcaattctggctagatatgcttcttttgccatatgttatgagtgtgttccacatagggggaacaaagttatctagtctccagagtccagtacgctcattgcaacatccaatattggtgactgctattgtccttggcaaaaaaataaatgatgatttgatgacaatgtcaggatgttgtttcacatattataatacccacaaaagatgtattgtttcttacctaatttgcacattgaatgcatagtcagtttgtggtctacaagatgctccaacaccataagttaaactacataaatacttcatcgttaagcaactaaaaattaaacgttgaatgttttcatcctctttacaagccttatggtgcacaactctataggatcgctgagg

SEQ ID NO: 12576 - DNA, 850 bp, Zea mays
tgagtaatggaggtgtgttattagcgatctgaatcgttggttttgattgtgtgttaaatttaggtgtaatttgtttagtggatttagtggggttataagtatggagtgatttgatkgagtgggttgatggattatatagtggtatagataaagttgaaggatcagatcaaattagcatcagtctctatttctatttattttggattaatattaattaaatgttcaaataaatagtggaaaacatttggatcgtgcgcagttgccgagtgcctagtctctccttcattgtctctgccagcccgggcccgcgaggcgcgagagagtcccttacctcccgtctgcaagcaggaggcatgggctcctttcgccccgaatcgggaatcgggcgtcccgggcccttctccttcctcgctgtcggcccgcccagatgatgcgcacagccaccccgatgacacatggcacacggcggggcccagatgatgctcagtctctctactgatatactcctcaccttgctcccccattcctctgtctctgtgtgtgtaactaactgtatatgcagccactctctcctgtcatcctgtgtcctcgtcctttccacccaaaatccccgatcctcgaatcgattaaaccctaagcggcatggcgggtagcgactactgccggccggcagtgcgcccgcgcgacttctgagccaccggaagccgcccttgtcccggctccactgtcgcgtgccccatccaacactgggggagtgggagttcagagccgcaaacgctcagggcaaccgggaggacgggaaggtgtggccgcaaccgcaagacgcaggcaagaggcaatcaactcaccg

SEQ ID NO: 12577 - DNA, 931 bp, Zea mays
caccaacaaatactgttttcaggagtctaaaaactgcatgattaattagttcatgcagtagctttgtaacaaattgcacaagttccaccgagattgaatcttatataacaacaacaatgcaagaacaggagctcaccaacaacgtatgtgtacacaatacctgttctgttgtacctgttgcagcttgcgcctccatgttaccatcatcgtctgccacactctcacaagaaaattgtgtcgggaacatgtctggtagtagagcaacaacatttacattgatgttgtttgtcgaggcctgcgggtagacggtagagacaccactctgtggtagccgcatcggacgaggagcaccatggactggagggcgggctttcggagatgcggatggcgggcactgcatattattgtggaaggtgagcgatagtgcgcgatagaagcgagagcgagatggggaatgctgtgagccaggcggcttgcgcggttcaggcgaggaagtccggcggggacgcacctacatgctactggcggcactcacggagacgagctccgggatgacgagtagctagcggtggagcttcgcagggaggccagccgcgcgtggcagcgaggccgctagagaggggagatcggggctacgcgcgctaggttggcggagcgcgtggagaggggagttgggggcggcgagcgccagaagagggagggcggcacagatgtttcgtcgcggcgggaaagaaaaaaaaaacagcgattgcggcctcgggagctctgcgtagttatgcgccagataacactcgttttcatccgcctatccaccggtatccacgcgttccccaatcgagcaaaaatcaatcccagatcccaatccctacacccacctcccaacaaaccctaactttacccctccaccgagcgcaaccggctgcgaccaaag

SEQ ID NO: 12578 - DNA, 231 bp, Zea mays
tactcctaagtttgggctttggttcctaggggatccacatttgatttgattggttattcggatgccgattgggcggggtgcaaaatcaataggaagagcacatcggggacttgccagttcttgggaagatccttggtgtcttgggcttcaaagaagcaaaattcggtcgctctctccaccgccgaagccgagtacattgccgcaggccattgttgcgcgtaattgctttgg

SEQ ID NO: 12579 - DNA, 622 bp, Zea mays
ctgcagagaaaagattccaaaaaggatggaatacactcaggcatcccccccccctctgaatcatttatttctgtccttattactttatataacatgggtgatgctttctgctttatcagggaagaagggcgttccattcaacacgagttgcgtgagattagtgatattgaaaaccaagcagtaggtgagtaaggtttctctatattagtgttttgtgttgtgctcgtgacattgatttctggtatggagatcattttatcctgaatttgcatttctgatgaaatgtgtcttctcaggtctgaagggaattcttgatcagcttcccagagcacatgcatctgaatttcggtcgaaggttagtaaatctgcatctgtctttggacatggtgatgtttataggaattgatcttagattttttctagccaataagagcttttaataacacacgtctcctaagcctgtattctaaaatacattgaagcctttgtcttactagttgctcctgacatggatactatgtgcttgagaatgaattttgttaaacagtataccatttgtatataggattaattgtagacatgccactcatcttttacaaaattggatggctagttcattttg

SEQ ID NO: 12580 - DNA, 1058 bp, Zea mays
atttatagaggaggggggctggaccctttacacaactgattccgagctaatcccgcttatatagctaacaaccgtagcacaaaactcagaaccctaatctgttctgcgcacgcgcggaccgttcggcccacaggcgcggaccgtccggaccgcggactgtccggcctcagtccgccggcttatttctggttcgaacacgttggttggtcgctcaagcagtccttcacttctacattacctatagaatgagtaagaaaagcctgccaccctacgccacgccatggcatcattattgccgagtttaaatagccggtcccttccgtgcagtgcccatagcgatacaatagttctagaacagtgtttgcagtgcctgcaactaacaaccgttgaagttgaaccgatccttgtcaatctcaacgacggttccatccccgatcaaattccacgctacgccatcaccctccacgagccagccccggcccgcccgtccagtccaccgtgccgtgcggtctgcagtgccgccgccgcgtcacttttgccgtgccacataaacaaatccgtcgccgttcgtgacgcgctggagaaagagatcccgtcccgtctgaactcttgtaaaccatgcgttctgcatgcgtcccgtatcctcgtctgttgctgttggggtcaggtcagtgttggcggtcgcggcacagcacagcacaggcctccatgcagtaacgcaatacaatactactgaccgctgactgctgtgctgtagtatcggttccccgggccgtgtgcctgccggggaggggatacaaatagtagcgcgtgccgtgcgtgtgacattctgagttcagggcctgggctgccgttacctttgttggcgttggaagttggacacagcccgcggtaccgcaccaccggcccggttcgcggtgcaataaattcgacgcgccgctgcctgtgcggctgtgcctgccgcgccgctcgtctcgacagacacacgcccacggagactcggagagggaggagggagggaggaggggagaggccgagagcacagggaacagacagac

SEQ ID NO: 12581 - DNA, 312 bp, Zea mays
gaccgtgaaggagtaagcttccttttttttttccagcttcttggcatgacggattacaaaattacagagcgattcatcgtttgagctcgctgctgtgcttggttccttacttggttggtgatcctagttcagaagtagaggtggaggactataattcaagtgctgagaggttggtgattctctcattgtcatctaatcgtttgggggaagctcaaaatcttgtacatcgtgtgtggtcattcccacgaaggatctggatttactgttgatgtcaccgaaacccgtcttagtgacatcgtaacttttggctcc

SEQ ID NO: 12582 - DNA, 242 bp, Zea mays
ctctcgcctgcctgcctacctacccatcccacacccgcctggggaaaatcaaagcgccgccctcgcacgcactcgcgctccccactcccctcacctcactcctcgtaacggctcggcaaaacccccagcacgcggtcgacgagacgagagccgagaaacagtccactcctcactcccgttccgtttcgtttccccagttccgcatggccgccgcgaggtagcggcgcaggcgctcaccgggg

SEQ ID NO: 12583 - DNA, 578 bp, Zea mays
ggtacatgaatgcttgcctgccataatcttctagtacttgccattttcctgtcatatcataaaggcatgtttttccctatgctattttgctctagccaaagtagtgacactagacaattagataatacacaccttattgttggatgcgttacatcaatcgatttgtttgtttatgtccactaataataagtccagaaagtattcttttccctccaaaaatgtgaccaacctaggagaacgagaaactaagcgtttttttcgttgagaagaatataggcacccaaattcaagttgagagaagacttgaacctgggtggctgggtgcatgagcacacctcccacctaatcagttgagcacccaaattcaagtaattgtatgagcacctaaattcaagtaattgcttttggcttctgcctcatgccttgttacaaattcaggggcagggggcaatgtcagcacaggtccttacgtgcatcagaaagaagccttagttgttgcaaaagagtgcttgcttgcagcagtgaaggctgatcctagagctgcatcagtttgggttaatcttgcaaatgcatattac

SEQ ID NO: 12584 - DNA, 357 bp, Zea mays
tctaaagtcttgccgaactagagttacatggctacctattctgatataagtttgcccctctctccacatgagcatgcgactatacatttgatttgctattaagaataccatacttgtacttcacaccgcacatacatagggtactacctggcagcaagtgcttgcttcatgccaaggattttgttgcttggtacattgctatgctcctactttgtgtgctcgtgcttgctagtagactttaacaatgtgtcgaatggcaatcactttcatggattttgcgttcttgctgtattggttatctaatctggttgcagttaccatacacaggatgaagaacttacacaacatcaagtgtct

SEQ ID NO: 12585 - DNA, 247 bp, Zea mays
atgaacatcatttggtcatggatgctggatttgataagtcaacatgaattgctagaataagaggaacgccaataagttcctggttcccagcatgttgaattaaattgattaatgtgatactctattactcgtaccatttatcataaggttctttatgcgaatatgaaatatctacctgtgtatatacacatgtactttactgttggttgttgcgtcctgacctgtggaccaaaaaggttcaatatga

SEQ ID NO: 12586 - DNA, 663 bp, Zea mays
cattagatataattgtatatgaaaattttgttggagcacaccttataattgtatatgaaaaatcctagatctgcattatagccgacttactattagttagggatattctaaacctaaaactaaaagattgttctgataggctaaatattttagaaatargcaggggcaatttggtcatcaacaatctattagttgattttagctggttgagacaattaacaattaataattattagatgtataactaacatttagccggtccattagctggcctgttgtaacctcttagctactaattattagatttagaggtttgaaacatggttatagatgagttggttgtccataaaaaacactccaacactatttaacgatgcaagagtttaatcatttggcctacgaattatctgaactgaggtccttgcaatctttgccgaaaacacccatggggaactcaatattacacacgttttgcttttacttcatcgtcctcgtagacgcagactcgtccatgtttctctgaaacgaaccaaacagacaccgtagatccgagcgctcctccgtcctcccgggccacggcgatcatcaccgccgctgcgccacccatatccacagcagagccgctcgccctatagcttcacctcggccgcgcgtggggcggcc

SEQ ID NO: 12587 - DNA, 1500 bp, Zea mays
atgagcacaatcttctctacttctccagttcagcgaccctcccctctgtccaaagaggccatcttgtgcccattttggagacctgggtctcttgaaacctctaggatgttggaactcatttcttttccaatatgaagtatatttgttgagcaaaaattcagaagttggtttaaagacggactgaaccctttttctctcgtttactttttgaaagggaaatgtgcccttgggcaatttctataagtattttggtgattagatgcccaacacattgattgagtacttatgtgctagaagtgcaaatcagagacaaaggtatgtttctagacttggtgaattgttttatgtactaacatagttatccaagtgctagaaacagtgactaaagaagaagagaagaaaagggaaagagttggttgtgtgcagccaacaccaattcggactggcacactggactgtccggtggtgcaccggacagtgtccggtgcgccaggctggccgacggtgaactggctgctctcgggaaaaagcagaagcgtacgactataattcaccggactgtgtggtggtgcaccggactgtccggtgagccaacggtcgttagcgccaacggtaggctacgcaattcgtgggcgacgcgtggctcgcagcaacggtcggttgggcacaccggacagtgtccggtgcttcaactgaccccgaggaccaacggtcggatgcaccagaraaggaaagagatcgcgcaccggacaactacagtaactgtccggtggtgcaccggactgtccagtgcaccacccgacagaaggcaagtttggccttccaagttagtctccaacggctcctagctgccttggggctataaaaggtacccctaggcgcatggaggagaacaccaagcttacaagaaacatcctaagactcctagacttcgctttcacgcaatcggatcatcgttcttgagatttgagcactactcgagttgtaaactccctgcgctgtgtttgtgtgctcactttatctcttgtgtgtgtggttgtgttgcggacttgagtcttgcttgtgttgcttttcccagccttactctgtgctttctttgtgatatcaattgtaagggcgagagactccaaattgtggagattcctcgcaaacgggaaaatactctgaaggaaaataccgtggtattcaagttgatcatcagatcacttgaaaggggttgagcgcaaccctcgtccattgggacgccacaacgtgaaagtagacaagtgatacttggctgaaccacgggataaaaatcgtgtgtcttgtgttgatctctttgcgattgtttgtgttcacaagaactcgcttcaggctacttagccttactaacactcataacgaagttttgtggctattagtgtttgatttgtacagtatcacctattcaccccccctctaggtgctctcaattggtatcggagccatactcttcatttaagggactaaccacccgaagag

SEQ ID NO: 12588 - DNA, 832 bp, Zea mays
gcttgcatgcctgcagcacgctcgatcctttgccgtcagttctcgtcctacgagtccaaaagaaaggagaaagagctctcccccgtccacggacacggaggaagccttaaaacttttgaatagctggagctcactccacgcacgcaaatggacatggcgtccctgacgcgtagactgctgagaagttttgaccccttccggccggcctggtagcaatggcgggctgttactggtagtatctacagcctgcaggtagtacgtgtgtggacagtgggaccgtggtccgtgtgggaggtggagagatgcacgcaccgcaccgcacgcacaggtgcttcgtctgcctttagcgaaccgtgcattgcaccgatccggcagcggcagggcagtagtgtgcgggtgggtacggcgggggcgagcggaccaccgagtggccaatacgaaattcctattccctccctgcctgcgttgaggaggggagcgatggaatccgggtccggggtgggtctgtcgctcgggcgctgggctcacacgagggaggcacggcacggcacgggggcagtggggggcaccggccagcccaccagtaccgaatgcacgatatgcggccccgcatcgcccatccctcctcctcgcgctttatatagccaccaccgcgcccgcttcgcctctcccgtccacgcatcgccaccgcgccatatcggcatatccgcaagaagcacccggcacatcgcgtcgcccccaccttccccctcccaccaccgcaagcccggacacgcccagggaaaccaggcgcaaatccggacaagcgctgccccggtcgcgcgcggcaggc

SEQ ID NO: 12589 - DNA, 1500 bp, Zea mays
cgacacttcaaccttcggtttactcgtttcacgtgtgatccagctaagcactagtgtgaagtcgtagaaacattggccctttcgttcgttctcttgggagagttccagtggcgatgaagcttttcagttttcacagctcggatgtgagcaaatccatcagctcctgcactgcatggtacggtacctgctacgttttgaacatttgtgaagcattctttttttttgcctttgtttaagacagactgcttatcacaaagctaatgatcactgtgattcaacattagttttgttcatggtttgttctgtctaatgatcactgtgcacattgataagacaattagtatacttgctgttgctgtctatgaaaatgctgcttacagaaggtaaataattttgttacatatactcgatagatggaacatattaaagacaattgtgtgccgcgtgtcatatattgtgatagtatgttttgtttcttatttcttacttctaaaataagtgtatacatttgttgtcacctacatacctctctgtagcatatcaactttgagcctactttgtttcttgctgtgttgccacgtacattggttggtgtagttttattttcactttacattttacatttcaataacaaaaatggtaaaatctagtaatatataacattctgaaaccagtataggtttaggtattcatatagaagcatagtaatagctttaagaaaaatgcaatgtttgatttgtctgttgttgaactttaaccctgtccacctttcacctagttggacaagtacgatttattcagagtgtttacttgtagagatagtgtgttcgatctgatggtattagtttgcattcgtgcagcgatttaattaagagttgcaatttcttgttaaacttaaaccatgaattgcctatactcagtttgcagcataagattttactaactccttacatatgcaggatcaaccgggtgtgtacagcagaggcaagttcaatgaaggaaggatcctctgagttgccgagtggcgtgcgaaactcagcagaaccaagccccaggagatctggtgcttcaaccctgtttggagggcttgggtttctaaggaactacaccagctgagatgtatgtgctcagataggtgttttttttcccaaggagaccagcagtttgagctgtatatgtaggtagtaggtaatagggcagttgccaaaaggacggctcccttttcctattgggaattgcgaatttttgtaggaactaataccttgcagagcaatgcctcgatgccaagatacagactttaaatttaatgttggattagatgctggaagagaaacatcctggtgtatattgcagtggaatgtactgctggaatacatgtttttccgaaggagcaattgcaactaagtttgtgcttttggtgcactggactctacctgctggctgatgttaggatagcatgtactgtatgcagtgttgctgttgcagctgaaggctgcagcc

SEQ ID NO: 12590 - DNA, 1013 bp, Zea mays
ttttggtgcccgtagagtataccttataaagttgtttaggattacccttaactgttgagataagattaattccttattattgtacatgtgtctttaatatttaaatgatttaaaaaattagtttaggctaaactcattaaatccaacaaagaaacaagcagcactctggcggccggctcgccggcagacgacggagtatctgagggagaaaattgggcggcacgtcatgcaacgaatgatgcgctgccaaccaacactgcttcgccaagtgccaaactcgcttcccaaacttttaatccccttgtgttcgcccactcgtcaggttgaggttgtttttttcccacgaaagcgaatgcgagcgccgagcgtcgtccagtcgcgctgcatgcgtgcgagcacgtcgggtagggtcgtgtccttgcattgtcgttgtctataaaagcgggcgtgccaccacggcgtttctttgcctccgacccttcgagccccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggatgaggggcccaaggttgacgaaccactcaaaatcaaagacggggaggagaagacggttgagagccaacacatcgaagaggagcatccgatga

SEQ ID NO: 12591 - DNA, 1473 bp, Zea mays
ctgcagaagtggactgcacgcgaattgtgttttcaaagaaaattgatgtagacttcctatttctatgtgccagtcgaaaggcccaacaagacactgagtcaaaaaataaatgttcacaagattaggtgtcctttcatgtaaattttagatatcaatcatatataatcgtaatctgattgccactctgcataacaaaattatatgtgctgtaggtatcagaaccagaagttcatgaagcatcacatttagtactccctctgttccaaaatgtaggtcgttgtagttttatcctaaatcaaacttccataactttgactaaatttatataaaaagtactaattatctaaataccaaataaacgcactatcaagacatttcatggtggatttaacaaaagagaattgatgttgtagataatcctgcattttttcctatatacttagggcccgtttggcacagctccagctcctgattctaagcgaggatctggaggagctgtgccaaacgagtatttttttaaactgattctcgtgtggagccgaaagatcgggagtcatttttgtgaagaaaggtgggatctaaaaaaacatgctccaccctcccttaaaacagctcctcaaccaaccaaatatggacctccccttaaagtttaatcgaaattacctgcaattgccattggacaaaaacataacgagccaatttatggattaaacatttgagaccattttatgcactactttgatgagaatattttatatgttattgtttcattttttttcccgtatatgcatcttacttattggtttgtaataaagttaaactgcaaagagtaaaacagacaatcgcccacagaccaccaactctcagaagacaagaatcagtttacttgccaaacagtttttaaaatgattctgatttctaggagaatcaggaggatcagctcctcacgaggatcaggatctagagctaaagaagcaggagctggagctttaccaaacgggcccttaatgtcgataattgattcctttcggaatacaaaaaatggtttcacgggtcagcagagatggcgccgtcgccaagcaaactcagcagccagcatgtcgcccaagcattaagaccaggcctcgaaactaccgttctgcccctgtaccctcttcacgggaccggcgcttggcgagtttggtgccgagggtggaaggggaatttatgtggctgttttcgttattaattttcactcggccaccgaggcagcgaacggctcaagaaaagaaaagtagcggcagcaacccgcggcggcgacgagtaaccaaccgggccacgccattgccaatcgcccgagccgccgagcaccaaggaaccctgccttgcccagccacagagctctcctccttccccgtctcccgctgcgggctctctgaactcggcggtggttcatttgtccgcttcttctgagctccttctcggcgccgcgct

SEQ ID NO: 12592 - DNA, 242 bp, Zea mays
acacagttagccacgaaccaaatagaccttaaatgcgcttgtacaacgtaaggaagaaattatgtgcgggagccttatggtcatctgcctcctctaaaatatctgtcttgcaaacgaaaatagatggacggcagtccgtaggccactccacctccacgatacaccacggcaccactcaacctgtcaggtagacttctctctcccgcggaagctcttacctccggctccgcaagcaagacttc

SEQ ID NO: 12593 - DNA, 242 bp, Zea mays; identical to SEQ ID NO: 12592

SEQ ID NO: 12594 - DNA, 635 bp, Zea mays
ggtacgctaaattttttctcgaacacgcagggagctgcgtatcattatattaagaaaggaagaagggtccaaaaatataccaagtacaaatacaaaggaaagtgattaaacaattttagtaactaaaatgattggagtaaacaagtttagatattgtacctacttccctgtcagatatatttctatcatatattttctaaagaatgtgtgatttctacccttggggtagtggaagctacataattatgtttttttcctctctagatctacgatttctttcacttctaatatgttgatggaaagaattttcatggtatgcacgttttcagtttatttaagtactatctttctactagtataagggtttttaacctgtgaaaaattcyaatataagtaccattttggggggattttttaagtcacagtttctctgccatattgaatgaatcaaggaaacactatctttcaagttatttgaaggcacagagcgcttgagttgtgcacactccttttgcatttgtgttacctaccttctaacttgcattcttgttctctytgctcatttgcagtatccacagctataccaagaaggagtgcaaaatatattattcagttggcgtcggatacttggctgg

SEQ ID NO: 12595 - DNA, 184 bp, Zea mays
tgattgatgatataacagcgcacggttcataggtcattttattgatataccgtacgtgcctaatggtgacaagaccgtgctactagtgcgtgccagtctgctctgctcatataacctcgatgcatgcgtccagaagatcgagctgcagccagtgcctaggattcgaccggcgtagtacgcagag

SEQ ID NO: 12596 - DNA, 678 bp, Zea mays
cctcgatagccgagaggacttcgtggtcgacctgtcctcagaattggtggagaaggacctacaggtggaacagctgagccaacgcattgctagcctggggcagcaggtggagatttgagacaacaccattgatgtcctggaacactagctccacgatgtgtaggaggagcttgaggaagctaatgaccacctggacatgcaccacctggagatggaggcaaacgagaccgaaagcgagggagaggaggctctcgaaaggttaggaccagcccctggtaccaatgcgactcactccgagatgcccccttcgcccgtatctagtgtcgcttccactactcagggttgatgggttaatttgacgcattaggtggatagaaacacgtgcgagcttagttggcatcagattttggactaggcttacgagtacttcccctaaattgatgttacccaggagaacttttgcgagcaatgaagtgattgtaatcatgttatcctcattcgagttgatgttatgttatggcattttctttccgtatgatataaagcatattgttcggaattgtgaattgggataacaatggcggcaatctctgttttcagatggcagctaggcagcgtcgtgggcagaacaagcaagttcccccgctacctcctgcagctcccacggtgtaggagctg

SEQ ID NO: 12597 - DNA, 558 bp, Zea mays
ctatttatatatatatatatatacgatatataaaaaccgtaggtcggttggctagtatagtggtataaatgtacagataagctcttgacacgtggcagtataacctggtatgcagtaattactacacaaattttagtacgttaggattctttatttattattattctctatttatagacctctaatcattttagtcatacaataaatacgattattcagtatatttgttccactgattcctctctttgcctggcagacaaatagcacacaatcaaccgtcgtctccttcctcgccttcataggcttctccaaattccaaatcgttgctagagaaaccaccaaaccggccggcagcccggcacctctcactcagtctctcaccccttgccaccactctcccgtggcgccttctagaagcttccggaaccagacaaccactgtgcgccgagttttctgaaggcggctttggtctttcgagatctcgttgtcggtgccatggcgggtcagtactgagtgcgcgggcgggagcaggtgaaggtctgccagctcgagatcccg

SEQ ID NO: 12598 - DNA, 1500 bp, Zea mays
agtggttggatggactaaggatatgtttttcaaaggtgttcaatcaagctcatttatctcttagattagaaatgtgattgaacggtcattcaaagtgataaagataaagtggcttattctcttaaacttatttcagtactaccctgttaaaaagcagtcaaaaagtataactgcgtgcatggccctttaccaaacaggacctttgccgtctctagttatgtgccaggaatatttgcgtgcatagcttttatctccttgtgtgttgttgaagacttttgtgtttcgtcccacagatagatcgctgtaatcagttgacgatgttctccacatataaatgcgtggtgatttttgatgacctcgagaaagcaaagtcaaacagtatacaccctgatttcagttctcacttttcaggtgttcgcttgattcatcctctagagtcaacggctcgacgcaggagtatatgacaatcgagttcacggagaagaatatttaaataaacaaattataaaagatttggtagtagagtacgcgtatattttctaacgttgattctaaaaacctacatcctcataggttttggaatttgatagtaatagtcgcctagtctctactaataaatggtaaaaaggtttaaattatacacaaataaaggttcaaaccatgcttattggcttcaatccgacgttcacactcacttacctaacagataacgtatttcttcatgtttttatactctatacttatttacttaggccctgttcggcagcccaggattccaggccaggtcagtaacagagtcagtccaggatcgagtgaatcatgggttgttactcattcctgtcaccagctcgtttccagatccggatccagtccggaaggtagatcacctggactcgttccaggccgaggattgagagatgggaattaaaatcagacgagtttgtttctgacctagatcaaaacgaacaactctaggagactggaccagattctaaactgggctgattcattcctgccggaatgaggcagggaacggggccttaagcaacttgcacctaactagtcggttgtgacatttaagttctatcaccaccagctacgtaccaacaataatcctaaatgaaaaaagttaaatatacgagtgatctctaactttacaatttaaatctatgaattttgaaaaagaaaatcaaattttagacttccaaacgtgttaagctgaacttgtctggtagcagcgttctgccatgacatgatcacattcacattcagtcaaccccgtcgccgtcgctccagcgagaagccgtagacaaatgtctctattcccattgccgtccatatttaaaccccaacttggtcaacactcacatgccatgctgccaatgccgcctcctgcctaccctggtcttccaataaatcaacctgctccccgacgcggcgaggctcggccatgcccgtgagctgtaggcgcacccggaggccgcagcacagcagccacgg

SEQ ID NO: 12599 - DNA, 196 bp, Zea mays
ggttttaagggataaagccgggtgcatctcatatgtgcgccaaggaagaacaacacatataattatagagtgcatagagataaatatcatcaatatcataaatgtacttattacatagcagaagtcttacaaaataaatgataaatataaaacgaactaaatcttatttccctggcgccacaaagatgactgggag

SEQ ID NO: 12600 - DNA, 655 bp, Zea mays
gggatgagactaactataattatttggaagccatatactctcaatatacactccctatatatatacctaaactatttatcacccatataatgatcacccattctaaaatgtattaacaactaatggaaatctgttaagcattccagtatgggtgatcacgttgcccctagggagacgtatataaaaaaatgtaaggctcaaaagtcggatgaggaactgaggattgaactaggattcatgcacaattttactttaacttaatgatcaagagaggaaaagaatagtaaaatggattattcatgtaagctttgtagatcaaacatgctaatctgttgttggattttgtgaagacccatctatcccaaatgaaattcattcccatccatttcctcaatcttgtaagctttggcgcgtgtccttccagctggcacccgaccgggtccacctcaccggcccagtgccgacacctcatccggcgccggggcccgcgaaatctcctcgaccgctgctttctcttcctcttcctcttcctcttcctttcccatcctttccacccatccacaccgccaccaccgcctacctccaccaccagtccatctcctccgcagcgtctaaagccctatccggatatccccactcgccgacgcccggacat

SEQ ID NO: 12601 - DNA, 1485 bp, Zea mays
tttttagaggctaaggcgaaattcgatatggtgaccctatccacatatatatatatttawygtataaaaagtgtcatactgttttgaagtttataaagtaataaatatagaaatataacaaaaacacttgttacatgatattactaaaaatttcttctaacattttatgatataaagttatcgtttatatcattgagatcaatctcatccaacttcctttcaatataaagaatcaccaaaccatttaacctctcttgagtcattgttgaccttaaattgttcataaaaaaatttctatttaaaaagcttctctccaccgaagcaatcatcatgtatgtatcataatagaattcaatttgtttttattagtggattcatagtgtatatgtttcatatatgtgtctatattcgtcgtcatcttaaatataaatataaaaaagtaaaatctaaaaatattattttagaacggaaaaaatatttaataagtaatttagacattagtttaataaataagtttaacaaaaaaatgctagtatctaatggctagaggctctcaatttttagagccctgagtgcggttgcaccctccgtctgtgcctccggcgcctcagcacccttcatgtatggccctgtgtttaagcataagtaaaagggaacatatttggtgcttaaagggtatagtgctcaagtatacattttaaatctgagacatccatctcacgtccagcgacaacagttaatttgattaaaaaccactctcaccaaaggaggaaggtgaaagaagtttttttgtaaaattagtgtttttgttagatgttagatgttggatgaacgttctagatttaaaatatgtatttgagcaccgtacccttttgagcatcgatatgttccctaagtaaaaactggcaaacactacttctggaaaaaaatcgcgtcttgcggggcgggcgccggcgcgccgcgctagctgcattttcagccaattctcattttggcgggaacatactctgggtctagcctgtttggtaattggtactcggctccactcggcgagattcgggagcgcgcttccaaacgccgccgcgattcggcatcctgctcgcgtgagaagcgctcatccggcattccggctccaaccgtccattctccgccccgcttcgccttttttcccgtcgcttccttctccgctgctcccgccgcccttctccggcaggattcgacggcggcggcggtctctgcgagcctcctcttacttcacggctgcctggagggcttcccgagccgcggcgatctctcacagctcgccttcctcgtcatcctgcaccgctgcggcctcccgcgccgtcgagagtgagcgagttcgggagcgctaccgctaccaaacatggagcttagctggagcgggagcccgtgtgagctggttgggagtcctaccaaacaggcattctaaccctaatcgagtggtgccttccctagccgtcggct

SEQ ID NO: 12602 - DNA, 1500 bp, Zea mays
aaactttttgtgaggtctcatgggctacctagcactagttttatgcaagtgtgcaccaccacactatatatactagacatgcctaggtcaagttatccctctagtacccatctttatagtattgctacaaattaataaatgtcctaacactgtactaagtgtccaactactcctttggcacttagaactagctattttaacctttttaagcattcctttttggtcgtatcgtcgattttcatcggatcggtattttcgccttttgagcacatgcattttcccgcattgtggcataacttaccctatagctgcaaagtacaagttagtcacaataaacttgcttgttattaatcatcagaaccaactaggggcctaaattctttcaatattgacggatacgaaataaatatccaattaagcttaatgttgtgatttctgtgtttaaataaatttgtttgcctaacagttggaatgggtatattatataattacaattttttaggagtacctaatatgacgtgttgattttccgcataacaataaaccttgtatttttctaagcaagggagtaattatttcacgtttacattgagtgagatggtctcatcaaccaatgataatataatatgatctgtctaaggacacgcatgggcatgagccaactttttattggccactaacctccaacaacatccggttaccatagcaaagatcacagtccaagtacgtgtagctacaaattttgattgcacattttgttttgtgtgtttgcccacatccccagctatttcccatcttcttttcttgggcacaaataatgaataaccacactgcacactacgagtgtgtttggtttgaggaatgaaatggtccatttttttctcactcctcacttttttatttggtttgtggaatagaatgcatgggttgatccatcaccaccccatttctcataagctaataattagtatatacacgagcagtgggtattccaccaaaattggtgaaatgaacttatgatgcatcaactcatgaagcataaagtgactccacaaaccaaacacaccatacatgtaccaacgactatggactatcgatccccaacctacccttgtcgtagctctctctctctatatatatatatatatatatatatatatatatatatatatatatatatatataaactgaaaattattggaaaagaaagatgagaagctgcatgtcagcagccgcgcgcatgggccaggccgctcgtgctctgccccgtccatgtaaatgcaactatgcaagcatccatcaaagctagtcagctacagtgacacatgcatgcctttttttcccagtctctatgattcgccagctcgagcctagctatatatatagtattctcgtcgcagcagtgccatcagatcattgccgcgagaggggagaaaggctagctatcaggagagatccatcgctcaggaacaggaagaagtgaggcgacagctctgcagg

SEQ ID NO: 12603 - DNA, 225 bp, Zea mays
ttttacagaaaagcccctgggccagggtgcgcgcgggggcgcggctgaatgcctgatttccatgaccagtgaccaccatgccatcttctttaccgataaaaatcaatccgggccgaggaagcaaaaggcgacgggggaaagcaacggagacgagggcaacggaccagggctgagagcctaagaccaccacacctccactgcctcacggacgagaacgcaggaagg

SEQ ID NO: 12604 - DNA, 308 bp, Zea mays
cgtgagtatccctgctccaatagatccaagtccctcgccgtcggttgcgatggttggagcgatcggtgggccattctcgttcggtagacatcacaggattgcttcctccctttccctctgcgatttagaacgatcgtacatggggatctggtggacgacagcggctgcatgtagctttcgacggcaaaacatttcactcgcttccatcacgttcacacgctcatgtgtaggacaagtcaaaatgggcggtgggtctgatgagtatttgatctcaaacgtgctctctcatatctggcaggacggcaatc

SEQ ID NO: 12605 - DNA, 1500 bp, Zea mays
cacataaacattccttttcaatttctacatctataatctataattctatatccataacactatataaaacaccggttcaaattaatctagatccacccaacaaatgacttccgatgagatgttttcttcgtgcaccccgttttgtacacataaaaaatcctacaccatcacattgaaccgtctagatcttttctccctcattctttctctcacgcgctcacatctaatgactaatggtcacagacatccagatcatctctcacgctccctcctctccctcaccggcggacattttattggcgttaaaaaaaaaagatttgcatgcatgtgcatattagcgtaaaaaaaggaagtcgataaaattgattggacatctgggctactagcataaaaggaagaagattgaaggatgtgaaaaagaataagaagtacgaatattgttctagataatgtaaaattaaaagaatagaaatggttggcgcgatttaaaaatagcttaagatttccaatataaaattaccttctacgttttagaacgaaacttttaaaatcgattgtgcttttaacttttttagtcacttgaaaaaaattattattttactgagtgattttttataaactattatagaaatgctctagctttgcaacttcctttggtttaatccaccagtttaaactttgcaaaaaacactgaaccaaatcaccctcacacccgtaatctccactaaatgcatcaaataaattgcacccagacttaacacgccatcaaaaccaatgattcggatcgctagataaacccctctcctttactcaaattcactgggcaatattatttggatcatccttcatccccactctccccgcgtcctcgccaccgtgttggcaataataggtaccataaattcacttcttggttctgtgcagttaggtaacatacagctctgtagtgtttggttccaaagtcagttgggatggaatggctccataccagagagtggatccgtccgagagatttaggagagccagatggttcatcatttaagcatattttttcttttttggagccactctgtcctacatggaaccaatccaaacaacaacaaattggaagcagagcggctccgtcccaccatattccggaaccagacactacctaaaccgcttctcttgactaaatcgcatctatcaagtattcaagtcactacaaggaaatgagtgggtcacatggcaaattgatgcaagaatatatttttctctgcacactttgtattacgcgtttgatggttatattagctctggttttcattttcttgtgctgctcttcctttgtctgcatgtacatgtattttggtaggctcgcttatgttttaactctaatggatggatgcatctttttcattagaattgtgaccacacatagagtaggaaggtttcattatgttactagatttggtgcacattgtacataatgctgatcaatatctcctttaatatagagag

SEQ ID NO: 12606 - DNA, 1500 bp, Zea mays
ccctccctcggccaacatgatagaggtccaatctgacctggtttggatgactagaatggggagtgttagccagttctattatgattgaatctggtgttgtttgggtgaccaagtcggggactcaagttggggggattggggtggccagttccaccctggtcatggctaccctcggggtcattctaggccatgtaaagctctttatctttgagagtgaacttttttatgctattcttagggtatcctaggtacggatacagatacacatcaacagggctcgatgtgactgaaacggcctggagctagggtgacactgggtctgacactcctttgttggagtctgatgcctctttggctccttccatccattttgcaaacatgccaactccaaaagtgtttaaacacttgtgcaatgaagtttgtattttcataaatattttaaagggctttttcacatcctcgttaggtcttatgtacatgcaataaattgattcacgtgtgacaattagataacagttttgaactttgagtatggctatgtatcccaaacatgatcacccactctattgtgtatcttgactgataaaaaaattctaactcatacctttgccatgagcctatgtatttttatttttctctttcttcttttccatgttgaacacttgatcatattgtggccatcatcacctccattagtgccatgcttgctcaaccttagtgtgaacttatcctatctcaatcacaacactagagtactactctagttatctcaacgaccaaaaatcaagcctagggtattcacccgctccattttcgcacacgcacacgggagtttagaacggatttacttttgcaacgctcgtataaaacaattgtgacatgctgtctaaacaaataaaatatttggaacatacaactctacttctgtcacattagaacaaaatattgtaaagatacttatgaaatagttgaaacatataattgctgtgtaatacttgcaacgtatgtttgtaatgtaagatcacctcgttgcttgggtgagtaaagtctcgcggcggccggcgtgtggagctcaacgaccaacgacatgtggaggtgcagaggtcattggtgtggagctcggcgtcacgaagctctccaataaatgctgctctatgcagtgtgtgtgtctataatgcggcgcgctaaaaaggtttcggaaaaaataataaatcacaaacgccaaaaaaaaaaaattacagccccacttggcccagctagaggatccacttgcccggaagttgcgtgggcttacgcattcgagcacgtgtccgtttgaactctcaaaagctctatgtcatcgctcgccaccaccaagataaatacccgggcaaggcaccctcgccgacgatccaccctttgccttcagcacagcacgaccaggacacagtgctccctccccaaagacaaacaggcgagcagcaaacacacacgctcgaaccgagacaagccaatctaata

SEQ ID NO: 12607 - DNA, 839 bp, Zea mays
agtaattacaacagagacccgaccttcccgcgcgggaaccccgtacaacggaaccgagcgaggatgagtcggtggaactataggaagatagactcaatcggttcactatttcttagatgcacgttgttatcatatctgtatgtattgccccacggtcgaatatataaggcctagggggcacccctttgaatccatctcactactcagccatccacctcaactctctacgtcctttgcactagagaattcccttgtaatccgccacataaaacactcccgccaggacgtagggtgttacgcatctctaagcggcccgaacctgtacatcgttgttcgcaatttctcgtgcgtcctgcacgaaccatcgagctacagtcgataacaccgtcctactcctaaaaaacaccttgaggggcaaccccgggtgtgcggtcggacccaaaacaccgacagctggcgcgcccggtagggggtgtgtcgccgatctaagctagctcaatggtcctccgccccggatccgtgttctgcttcggaactatctcatctgtagcagacgaggaaggaactctacatcgcatcgcagatccgccaataaggaagtctcctccaacaacctccgagaatatcggggtaaggcagggaaaagcgcaacctccagcgctccgaaaaagatcgccttcagcaagccaggggccgagtgcccgctaacccggaggactccactgtctacctctccgacgaaagaatggacacaaatcgcaaggaagaaggaaacaaataggaagcaagttgttctttctgtacctctgccctcaaaggagaacagaaagaagatcgcc

SEQ ID NO: 12608 - DNA, 56 bp, Zea mays
ggcaccacacctcagctcccgctgctgccctcttaatttcttccttcggcttcgcc

SEQ ID NO: 12609 - DNA, 646 bp, Zea mays
cgtcatttaaggaatgaactcatgatgcaccatctcaatttggatgtaatgattccttaaaccaaacaccccctaaatttagggtacataactctttagaggttcttcttagatctagtctaaggctctaagccaaggtgcagacggtgacagtggccaatagtgaggagcagctcatggacgactgtgcatgcgacaagatgcacgacagcataggctacaccacgtcagcatagagatgtttaaaaattggtatatttgccaatcttatttaaaaactgttggagataatttttggttactaacacctcaaattaattttagggacgttttttaaaccccgcggggatgctctaactagttttggctcgcaccaaggcacgggcggcacgccactgtgtgcggcacgcagcctcggccctgagcacaaagtaccatatgcacacaggatcacctccagttctctgcccaatcagtgtgctatatctgttcaggaatcaggacgtcgctagcaacaagttgtcaactacccaaatctgcacgaggtcaataggagtatctcaaatcggctaacaagtaataatcctctcgatacccgaatcggtgaaggaaaacaagacgagtccgtcggtcgtgatcggtacca

SEQ ID NO: 12610 - DNA, 458 bp, Zea mays
ctgatttgtgatcaattcttgttgctgggtgggtcaccatcctgtgcatttccttgtgagttgctaccactgcctccactgttcccatcctgctgcgatgtttgccctcccagtccactgaatggccacggcagcgacacattgaacctcctctcaaccacccttggattctcctgcctctcctccatctgtccctcagcagcagtagagctcccagatgcagcagcagccacaccaacagccggctgaggattagtgcccttccgcccctcgtaatcaggatcgtcagtaggcagctcaaatcggcagatggggcacgagttgtgaagctcaagccacggcacaatgcagtcagtgtggtagatgtgcttgcagggcatctgcttggccacctctccaggcgagaaatcctccttgcagacggcgcactcagcgccctccgcagctgcgaccatggc

SEQ ID NO: 12611 - DNA, 1485 bp, Zea mays
tgttgcttggctcggtcggtctaaggcattctgcagctgattactggtgttgggggccttcgtcttcctaaggtcctcaaaaacatgatttaataatgtttctggagttgtaatacatgaacaggtactttcggactcggatcagaaccacagtgtgaagaagcacaaagaatacaaaggttgatgcagcgccgaagctacgcgcaagggagcttcggcatgacagcagaaaaggaaaccgacttaaaagggaaaaggctatttagacctcgatggatcactatagagtcattagtaaatgtaaagggcatgggtgtaattttacatgggctgcgtcctgtgcctataaatagatgaatagtgctcccgtactgttcacgctgacttggcatttgttttgcatcacgctcgtacctttgttgtctatcaaggcgaaggtaacaaatgtaattcaatattgtttctattttctcatgacaatataatgaagatgaattgataatgttatatgattgtttatattatctttcgtattttacacgcctcttctattaccatcataccttcgatattcgaaggtatgtccttcatgaccttcgtctgaagatcattatatcctaagggaaataatgtttcgaaggacgaaaggcattaatatttaacattttatgttgccttgttcttgattcatagcatttgagaacaagtccccaacagtggcgtcgtcccctcgagatgatgcaacaacgacttggtagctcatgatgtgctaggccagatctgtgttgccgttgtacttggggtaagtgctggctctcaaattagcaggccaaggtgaagcttggagctgcggagcaagcggacttcactcgttgaggtaatttattccctggaaagcggctggagggacgarggggccacsctgcgggtggtatgggccttcaccttgtatattttgttggaagacagccggggtcacgagggggccacgctgcaggtggtaatggccttcgctttgtatatctgtgatttcttgctctagttcccgagccttttgttcctcgtccagtatcatttgtcgcactttggcttgcttggtgatgcgttggcatttggcttcgagttctttgggccaattccctgtatgccattgaaaaatatactcgttccttgtgtgccactggccccacatgtcatacacacacacacacacaaatatacttatatgccactcagtggcacacaaggaatgagtataaaatctgatggcataccagaaatttttactagcagagtagttgggggatgaaatggaaatcggatcgaaccgcaaccacagccaataaaaaaaacggagtagctactagaatgaatgaacggtaaccgtcgatttgttgaggtcccctcctcctgtaggtgtccaacttgactacagccacctctcggctccattctgcccctcctccttctcagtcggcagccacc

SEQ ID NO: 12612 - DNA, 1500 bp, Zea mays
atttgttattactcttctctctaatcactaacctttgacaggatcgatcgctaggaatttggttaaaccggttgcgaacgtacaaaatgagtttggtaattatgatccggacactttgaaaacggtgtttctgacacactacaacggtgtctaatcttcgtgaggaaagatgacgaaggaaataaagcagatagtacatgatttctcgcgtcgacaataacgcgcagcaatgttcgatttatcgggcttcttgtataacgcaggagtgtcacactctaatctctaacagactaacactaacgaattaagtagaaatggcgaaagaagagcgagaaggtacgaagagtgaccggaagaaagtagaaacccagtcaccgctaaaatccctgcgtcggctacaggtacaggttggtccctccctatcatatgcatcctgaccttggcgtgttggccacgtcacagtcggctcgctcggaccgtcgacttttggaggccttcgtgcccgtgcaaacgtcgctcaagtccgcacgcgaagcgtcgttgtgcgtgcctgcccgtccgcggtttcgcagcgcctgccgcatctgcccacgtggtgtatcaagccaagcgcctgcggaaacttgttctgggctgctgaactagttgggccgtggcgaagaagatctagaggcgtcgcggcccgtcaacgtagctctacggtctgggctggccccgacgtccgggtacctatttatttttcttttgagttatacaaatgcatgaatctgtcaggacatatagttcggtttcttttttgtttatttttgtgtgaagcagcacggaacgcgacagcattatatatggtcggccagcccaccttagctatatcctggtctgtcagtcggtccttcatccatcccgccttcctttgtccgtcgcctctgcgcaaatgttgccaaaagtactggtgatcgagccagagtaaaagggagagacgaccatgcatgcatagcgctcgacacgtcgacggctgcgtcctgtagagatcggctgatcgcgacgggccgccgaagctccaccggccgttgtcgtcgtacctccgacgactcgaaacgaggggagcctcgtgcccactgatgatggtgctcgtgctcgatcgtccagagtcaccgtaccccgcaggaggctgctgcagtcatcttgccggccgggcgactaccgccactcttcacttccaataaggtccacgggaccacgtccactaagaagcggggtccacacatgagtcatgacacgtgccatgtcatccaccaaccagagccggccgctcccaagtccggaagtccccaccacacccggctataaatgagtggccgccggccactctcctcgcacattccctagctgctagctccacttcccacccccaccggctctatgccgcagtgtgcgcaagcgcaagcaaacccagagccccacctgccgctgtgccgccactccgggtaaccgcgcgtgggg

SEQ ID NO: 12613 - DNA, 96 bp, Zea mays
ggtcgtggtccagtgtctctcaaacttcccaagaagtgacaagtttaaggtttagggtacgataaagttcaagaatgaaatgaaacgaaacgatat

SEQ ID NO: 12614 - DNA, 421 bp, Zea mays
tggcgcagactcctcgcgagagcgatcccactcgcccccgcctcctctggcttccccaaaccgctaagccccctcctccacatcggtggaccgcgcctaaccacctcttccggggaccccgtcgcggacggtggcatcggcggcgaagatgaccctttctgcttcccggaccactactacgagcagctcccgcccgatgtcgcccggggagtggacgccgtcgtagcagctgccgaggccaccgacctccaatgccacggacgccgcgcgggccctcgacgggtgcggcgccgaggcgtccgagccgctcgtggtggcctcgctggcgcgcctccggaacagctgcgccgccgcccatgccgcgttccggtgggccgccgcgcagcccgggtacgcgccgggccggcgcgcgtgccactcc

SEQ ID NO: 12615 - DNA, 928 bp, Zea mays
agcatgactatggcgttgcaggttttcgttttacccattttggtttcttggttgccacattatctaatgacctacctggcatacttatattgcaatagcatttcttgaaatctggaatatttgaccaccatcagctctaccggctgtgtttatcgcgttgccacagaacgctgcttgtttgtctccgaaaccaccagtgttctctgtagcacattagtaacaatttgctggtggatttgatatcatcttttttgaatgatggtgtattggtgtacttgtgatcgataatgaaaaagacatcttgtgttagtggcatctagtgctgttgtggctggaacctggaattgttcttggattctcccttcgcatctcttattttgaaacccggtgcggattgttcgcacgagagcgttttctgacgaggtgggagtgcctccacctgtaagtcccagacgtgaaatcttcattcaattgcgctctgagcggggttccgacgcagcttcctcacgtgcctagccttccacacttctctgtctgcccacccgtcgccgcctcatcctcctagggttagggctcgcgtcgcggggggccgtggcgcctggtgcaatgcggaaaccgttggggccggcgctctgtgcatccgtctccgcgcgatctaggtgctggtggcgttctccctgatcgacgcgctcgccatgttattcttattcctcgaatcgccccttgtgtttacgtcgctgctcggggcaggggtggctgccgcagcgtcgcggaagctcgacctctatgacgcgaggcaagcaatgccggcgcgtctcgtgaagagcatccgcacagggaggccctctcgacggacgcatggtggcgatgggcgcaccggttagcgtggatcgtctctggcctcgacctcccgccacctcaactctac

SEQ ID NO: 12616 - DNA, 198 bp, Zea mays
ggtaaatatgatcctgctgcatatcttgattgggaattggaggtagaacagaaattttcatgccatgatattcctgctaatagccaagtgaaggctgccattagtgaatttactgattttgctttaatttggtggcgtgagtataaacaaaaacttcccattaacagtgtcactacttggacccaattaaaaactgcc

SEQ ID NO: 12617 - DNA, 513 bp, Zea mays
ctgacccttttttcaaattgttggtggataaattaatcttgtgtgcgtgttagataaaacacaagggttatagacagatacgaagagaaacagtttttatattcacggaaccagctatgaaaggagtgaatgaaaaaaatggatgcgagaaattttggtttaataatatatttttaatgttaacaccgtgcatggcatatttaagtagccgtttagttcgaattaatagctaaatgtttgacgagcataaagcttaagcattcgccaaccgggtggtagcctggtaggtatggtggcgaccacgaccagtaggatattagaatgcactccaccctgacgagaccttctaaaatctttatggcacttttcctttattcttggtgctcagattgcatcctttaatcatcaccattcaccatagacaagttaacaagtcaagctgatcgagacgctcgcgccagaggcttcttccaaagcagggagaagagaagagaagagaagagggagcgagct

SEQ ID NO: 12618 - DNA, 1127 bp, Zea mays
ccccctaactttatgcccaccatgattattagctaaaagttcatttattgttaggtcccgtttggttactttagtccagtgactaaaatttagttaggagacttctacggactaaaattatttaaaacacattaaatgaatcataagaggactaaaataccacttagcattcttccgcaattagtacaactgataaaacaagggcaaaaactggaatttatatggtttagtcctttttggtcaccccttgagggactagagactaaaacagtttaatcactattttagtcccagcgtttgccaatttagggactaaatgggactgaaatggagcattagtcccttataccaaacggggccttataaagactcaccaaatgtaaccttacattagcatagcatgcacacacctcaaatgctgttcagataaatggattgtaattgtaagcaagcaacctccgtaacatgtaagaccaaatcaacaatgcgaactgcaattttacgctcgaattaagcgtttatgcaatcccacgatcgcgcgagctactaaccctagcatctgagggctgaggctactatctcccgcagaccacaccgctcctgagcgtggaaacctagacgcgacgcgaccgaatcgaagccagcccagccatcagatcgtgactcacctcccgatctcgcaggcacgaagccgcgcctcgtcgcggcgccggacgcggaggtgctcgcttcgtccatcttctcccgccacgagctcggtcgccgcacaggccctcgtcagcggctcgccggagcccgtgctccgcagtccgacccgccgggggatccgaccgcagaagaagagtggagagtccacttgctgctcgatgaaaaggagcccatgggcccactaaatcttgagggcctatctaattcacgtgggccttatgggcccaactcccgggggcgctcgaattgacggcgtgagatggatactaacggtgactaacggtcgatgtaacggccgcatcaatgcgccgcccggcgcgtcgcgatcgggggaatcttttccccatttcgtttcgcccaggagcgacaggcgcgggcgccacggagtgtgtgtgagagagagatagagagagagggag

SEQ ID NO: 12619 - DNA, 1241 bp, Zea mays
ctgcgacttcgtcgtcggccatggcagcgagatagcgtggttaggaaaggcggaagcgatggttcggaacgaacctctgtgataccatgatagtcgaatgattgttgtattattgattaacaagaccaacaatatatagactaggctccaaccggttcatagaaacagtgcccggtagagatggacggtgatcacctgtttagtaccttctaagtatagccatgcactagagatggaaggtgatcaccgtgcgtatacaataatggtggcatgcaatagtaaaacaaggaagatgatcaatctaaatatagtaatccaacaaataggagcggatcttcgtatcagtctaaatgtctcactccgtaacccaccatgcaccaaccacattcgtatcggacatgatctttttgccattttgtgggatagatgtcacgtaaaataccatattaatgactcagttgtcatgactgattatttagtgttatctataaagatgataaaagattaaatgtttccatctgacacacactcgccacgacaccgaccttgtcccaatctgtgtcctaaccttatccgttgatgtctcgcacccgctattcccattagttgtcggctcgtcgctatctggcgcctaccctccatctcctccatagtacaaccacagcctgcaggcgcccaggctctagactagtggacgacagtggctaatcagctaggttgcctaacacaaggtatcgaccgtctgttgccatcgccagggcaacatcgccacggttgaccggcttaataggtcctttgattcactaatggatttgccactacgtacaataaatattcagtcattaagggtttacttcagttatttaattatttgcatcaggttaaaaaattactgatggtcaaaaccaaaatgtattgattggacgcgtcaattatttgaagatgggagcatccttggatgaaaacggtaatggtaaaccgtaaacatatgtttggatgtctagaatcgtggtaggatgaccgaactcccgtaacaatccgtcaatcccgtcacacattcaacatcgagacgcggagacggagacttgaccatcagcaagtaagacttgaccatcagtctgcagagcggagcgaggtaactgcatatgcatgctaatggcgaaggcgacgagtcagcacacttcacacaagctttcgcgacgcccatcggcactagctagctagctagcaggacggcggcg

SEQ ID NO: 12620 - DNA, 1476 bp, Zea mays
ttgggttggcgtctccgtcgggatcgccgaagcgattcggaaatcttgcatgggtgggcattgggttggcgtctccgtcgggatcgccgaagcgattcggaaatcttgcatgggtgggttagctgaacttgcaaccagcacacagacgactgaagctcagagttagtgcttttcttttcttgtttcctacagaacgcgtcaagaaagagtccagattggaggcgccggtcacagtcaacgtcagagctggacagtcaaatcgtaagtttgacttaaggaaaaacaagcaaagatttggctcgaacaatgtttcctccgtgacacaggcttacatttagacatgttccacatcacccatctcacaaatggaaatggcgacagaaaagttcagaaacttcatagcctaatccaaatttttttccccgttacttttacaaatttcatcccatttcactagatatttaacaactattttgggcaaaaaaagaaaaacccagactagcaccaataaagagtggttcaccccactgtcaacatattcccacctttccaaacatcgagtcttttgttactcttgtcaattaaagataaccaataactgacatggtaatctacttgggctgacagtaactctcaaatacctaattgggaaaacaccaacttggcaattaaaaatgtggacataaatttgaccctactcctgttcatcattcaccattacaatctcacttttactaaaataaatctttaaccccatcctttaaattattgtttgaacggtttaagcttttgctgaatcttatctagagcaggtttggctttatatgtttctgccagattagttccatagctaagaagtcagcattcattaactaattcagatcaaacttaaagtaaaaaaatgtaattttcacagtttccagttgaaagaagcaggggattgtgttcataaatctctctagggattcatttatccatagcttgtggaaaaaatgacttctcaccttttgagacaagaattcgatcaagtttttcccaaaatggggaactcttgattgtttgaccaagtgaaaaagcccaccacacattaccaactctcaaagttcataaaattgtgaatcaaagaattgagatggttttgtgtttatgaacaccattcatagtgttcttgtctttcacatatctaataatgttgaagtcacatccaattaaaataggctcataatttgaataaggtagtctatacaattaaattcacctccaattattatgttcctgatataatttagtttcactcctaaatttggtttgtgctctagggccttggtgttgacgccagaacagaaaaggtttagttgaacacttctgtactagagctggaccagggacattttggaccttcccagatgcaagaggggaaaaagtaaacatactatcagtggcatagcagtgaggagccccaaatccactccaacg

SEQ ID NO: 12621 - DNA, 76 bp, Zea mays
cgaatttcggtcgtttctgttacttgccatttggtcgttatcaacaatctgaaagtaatgatctgtggccttggga

SEQ ID NO: 12622 - DNA, 1500 bp, Zea mays
gggccttggcacttggtaggaggagcgacgctggtagcgcgtagggaggtacaggtaggaacccggaggaaaatctcagggaaaagtttgtccatgcgccgagggccgaggccccgctccttctcggctcgggtcccggggcactggggctgggagttcgtcgcgaggctcgaggcgacaaaagcgtccctcacctgctcatccgacgtgccggcaccctctgcaactttgatcacccacccaagggctgacgggcatggtcacctcgcctgggtttttgtcccaaagattttttcttttccctttctcgattgaagcaagtcttgtttcatcaataaaaaaaagaagtttgttctcgccaagaaaaaatactactactatacactaagaaaaaggccgccatgaaccaacgcccaacgatgttcatgggttactttacaccaccaccaccactgctttacacctcttcctagtttcagtgcctgttgcgggtgttggcacactcctccatcttgccgaagctgtgtgggcaggatgagtatcagcttctgctagcaataagaaaaaaaaagcgttccagatctttgcttctcccatttgcaactggcacggcaatggcaatgaatgggcggagcgtactgccgcatccattcatggcacatggacggagcagcgctgctgcacctgtcgtgagccccctccctgactgaccgactgactgacggggactactcgccttttgcagcaagagatacagggactcgagcgcattcagcccgtctcgcgatgttgcaatgagtaaataataaaaaccctctcccgctcttccgctttctctcgtctggaactggaactcaaacatcgtcactgcaccattattttctgttatttcattttagaatcatttcacttgatattcagaaataagcagttgtaacagcagttaccacttcatttgtcgcgacaagaaaatagggaaaaaacaataaataaaatatcttcatttgtggcttgatattccttgaccccacgcattgcattcccccctgggaagaaaacagactcacatgaacagcgagaagaagtacactgtagtttttcttgaacgtttgcttcgtgtactaattatatcttgtcctggtcgtctcatactccacatttggactgttcacacatagctcagattccatttacattcctgtttgaggttgcaggataagtggtagctagtgtatcaggaaaccaacataatagtaatacagtaggtgggtcctgtgcagttcttctttctcttttttttttgaaaaaaggtactattgaacagtaatattatagttgcgtgtgtctttgattacgatgttttgctcacaaagttgctactgctttccaataattcttgacagcgtcaacgagtttgtcagtgcaaagaccgacccaatgataccagtgtatgaattcttaacttgattctctcatgccaggccagcagaaccatggccc

SEQ ID NO: 12623 - DNA, 1470 bp, Zea mays
aacatatatagagagatttttttacagggtgaatatttgtatgcccagagtaaccatgtgttctgatgcgcaaaataatatattccgacgtattagatttctcaaatgtatcaaaatacaatactctattcttttattagctgagtttttttaccacgattataagtctaatcaagtttaccataggagcatttcttaaaggttgaaccttaaatatacttgaacggtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcagagcccaagtatctgcagtagattggtggagaggaagaagacggcaggcacccacgcagatcaaacgtgctccgccacccttggtttcggcgaatcggcgccgtacgccgtaaatcgagccgtctccgagcagatcgacgcgctgcatagcaattcgacccgtctccggccaaatcgacgtccagagctgcaaattgacccatctccgcgctgacctccgcttgtgcctgccgaggagcgccgaagttacgcccttctcgtgaaggtgtgcgctccgactcacttagatgtaggtctatgtaagaagaagaatcccaaacaataagatggacaccaaacgcatagcttttttgtatagtacttctttaggaagtggcttccctggccagctctagaaaagccagctcaagcagatccagacggggccgactgcgcaacctgttcgaccggtcctgcaccgcctctcgatcgccgagcttggctctcgatcccgccgctggggcacggttgggggcttgactcacatttggtgctaaaaatttactattctagagcattttgcctcctcattcattaactcagattgttgagatggcaaaagatgatgtttattccgcctgaaatcttatttgcacaatacataggcatttttatggcatttctagcagctgaaacaataaatactgtttgtcggttcactgaagcatatatcgtttctaatttgggaattgagcctcacttagatgatggcatcaaatgtttgaccttgatgttctgctaggtaacattagttggttacttttatctggatcatgttcatcacggtagcatcatatgtaatgctgtccacacaagtcaatcccagggatttctttagctgtaaatttataatattttgattaattttaatccttgattatattgtcagagatctgattattgattttttttttcaaacttgccttttaaattttgyttctctctatttatgcaacgcaagttgtgttaaagtttcttttttattactaggagtagaaaatttagaattaggaagtccctaatgttatttcctcatttacaaatttagacatccttgataaacctg

SEQ ID NO: 12624 - DNA, 1500 bp, Zea mays
gctgttgtggacctcttcctcttcgagggattttctattttacaaaatgacaaaatactaggatttagctattaattttagccaatctgttggagtttctttcacttcctttatcagtaagggcccgtttagatccgttaacactaaaaattagcgactaaaattaaaactagttgatacaaacagacctgctaataatctgataattgttaacggaagggctgctaactattactagttccattagcaggatatggagctgctaaagattcatatgcacctttgaaagggaaataggcttacaccttttcctaattgattttggtggttgaattgcccaacacaaacaattggactaactagtttgctctagattataagttttacaggtgccaaaggttcacaacaaaccaataaaaggaccaagaaagggttcaaataaaaggagcaatagacccaccgaagtgtgcccctgggtctggcgcaccggacagtgtccggtgcaccaggaaactcaactccgaactactcaccttcgagaaaatgggaggctgctccgctataattcaccggactgttcggagaagcaccggacagtgtccggtgtgccagcggagcaacgactacttcgcgccaacggtcgactgcaaacgcattcaatgcgctacagtgcgcgccagagtcagagcagcgacaaacggcgcaccggacagtctacaggacctgtccggtgcaccaccggacaacccagaggccccaccagtcagagctccaacggtcagaacccaacggccgactgacgtggctggcgcaccggactgtccggtgcgccatgcgacagcagtcttctaacggccacttttgttggttggggctataaataccccaaccaccccacattcaattgcatctaagttttccaccttcaacacattacaagagctatagcattcaattctagacacaaccaaagagatcaaatcctctcccaagtctggaatcactccaaatcaaatagtgactagagagagcgacatttgtgttcatttgagctcttgcgcttggattgcttcttttctttctcattctttcttgtgatcaaaactcaattgtaaccaaggcaagagacaccaattgtgtggtggtccttgcgggaactttgtgttccgtttgattgagaagagaagctcactcggtctaagtgaccgtttgagagagggaaagggttgaaagagacccggtctttgtgaccacctcaacggggagtaggtttgcaagaaccgaacctcggtaaaacaaatcatcgtgtctcactctttatttgctcacgatttgtttttcaccctctctctcggactcgtttatatttctaacgctaacccggcttgtagttgtgcttaagtttataaatttcagattcgccctattcaccctccctctaggcgactttcaattggtatcaaagcccggtgcttcattagagcctaaccgctcgaagtg

SEQ ID NO: 12625 - DNA, 1500 bp, Zea mays
tagaagtttgcacggttgctcccttggaactattgcctgagcaagaacaattctgcttgctgattattctgacggcgtggtcgtttggtaggttcgggttggtcgcccggttcttcactctgttggttcttctgcttgtacagttgtgctgcagcgtcccatttgtgagtacatcaaacttgttatgtttttgatttgccacgctttgcttagcaggcatcgctggattcgaagacaaattcaagattgtttttgggaatttcaagctcccttttttttctttcttcctttcttgcgatttttggtgttggtttgccacgctttgttcggtgtagtgtaggcggtagtttgcgtgcagtgtggacagagtggactgtggagtctcggctgctggagtgctggtgttgccggtccttgttcttcggctctggtctcttgacttggaggcaagggggtgcgcgacgctcacggaatgtttgggacgtcttttcttctcggtgctgcggcgaccgaagacgcctgagtcaaccgggaccgtagctctccagtctccaccgtcatctatcatatctcatcatcttttattttaaactttactatacaagcggtaagcggtataatgtaaaaattctctattatacacgatctgttgtgaacaactttatttggatcaccgcttaataattgcgtgcaactgcatcgttcgcttgcgaaacctgtaaaggaatcagcgacacaataagattatccgcatcatactgtataaaataagagatttgcaagatctgtgatatttagattctggtgatagctagatgattcagttagaaaaacttttcagatttttttttgtcccactcagccctatagttttactcttgcatcgccatcgcttgcgtttgcatcctcgctgccgtctgtctggacgtgaggttcaaagtagattagtgagtgataatatagttgtttagtgcgtgatggagagatcgatggtccggcccgtactggaccaggaggacggtgaagtaagcagcaggctggcacccaacccacgactcgcgcgcggccgtcaacgccaaacgcgttggctgatgccaccaagaccgttccgcacgctggctgttccttgtcttggtaccaaagcaacatttcatacaggcctcgctcctcgtcgtcttgtttctaaaagcctagcttgcgcgggtttagaatagaaaccgatcgacagcgaatcgggtatacatatgatcccctcgctcgatcgctccgtcgctcgtggatcaattgctgggaacttgctctacgtttgccgcccacatgcccaacacttacacctcctcgctcgtcgtccaagctgatgcccacctggctggcctgtggcctgcatgtatatatataagatacgacgcatgtcgtccgtccaagtccaacgcaattaatccaaggcggagtcgacgatctcttcgatccacggcaacagtacgtacgtcaaattgagac

SEQ ID NO: 12626 - DNA, 481 bp, Zea mays
agtaagtgagctcatgcacattatttcccacaacttgttgagcgattaatgtatgtgatctcacacttgttgtactcacatcccctaggtcaagaacatgtaccacaagataaggagcattaaggatgtcacgatgagttcgtgagaggtctaggtgaagtacaggtaccacaagatgttgattttaaggcggtttttcaaaacccatgggtttgcgggtatgagtagtggaagaacaaacctatgcccacgtacccgttgggtttccatttgaacccattagcaaatccatgagtacagaaattgacccaaactcataccctaatagagcaaaaacccaccgggtttcgggtagcggatacccagtgccatctctattgataacatttagtgctattcttgttatttttaggactttgggagtaattccactttgttctcgttggatttatcaggtgtcatccctgcgttctgatccaag

SEQ ID NO: 12627 - DNA, 177 bp, Zea mays
tgatcaatgtaatatgcagatattaacattggaacataacactgatattcggctggttgagagtagttctatggatgtggaagctagaaaggtgaaaacattgctacaatatatgatgacatacgataatgtaaaatctgacttgatatctttgttttgtagaaactggaatttcat

SEQ ID NO: 12628 - DNA, 194 bp, Zea mays
atatatgcactattgtactgtacacccagaggtaatggtttgaccatcatcagtttactggcgtactgcagtgggctcgatggcagcttatacttgtgatagccggtcagccgagcagtccatccattacccagcacatttccctcctaggttttgcttcatgcatgttttgcttgtagaggaaggtgtggtac

SEQ ID NO: 12629 - DNA, 302 bp, Zea mays
ggttttactattgtttacccatttgatatgagcttttcatggcttttaagttttaaacaaaaaaaattgtgggccgttgtgatgttttttagcaaaagaattattcaaatttgagaagaacaaatatgtctagtagcaaactgggccatcttttgtgtccaccagcaaagggtggtcactttcagtatcctgtagactattttaccttgaacaaaataatgcatttcatttcttgtaaccactgacggtaggtctgttttgtcatacttgtcataactccattattgtgctcaggtagaaca

SEQ ID NO: 12630 - DNA, 325 bp, Zea mays
gtaaagagcgtaactccaatgactaatctaggcacatggccggctgggacggaggagactccagcattcactttcactggatatatatgtcggtgtgcacaactgcgcatgcgattcattgagccagcaccagccgtactcattttcttcctagcccgcgagcgagggggcaccgggcacgtggacacccctctcggtatccgatcgatccacgatatttatcacctccaatccacctcgtagtcgtattctgtatgcatcagccagcaaccatcagcagcagcagcagcaaagagtcagctagacagacgtgccggggctcaag

SEQ ID NO: 12631 - DNA, 1177 bp, Zea mays
tgggtggactgaggccggctagtgtgggagaggtttgggcgtttggctgagtttagggtttggactggagggggtgcttctctttccccttgggttcgaaatgtttggattggacatggagggggatgtagattaaggacatcattgagatgcagatggcagtggtttttttatctgtccaaacaggactggttcatatgttcagtacaagggaccactatcactgagctaaactcgaaaaactgaaataaaattcagatatgaaccaaattgatcataactattgtttttgttcctaatctaaaaataatcaacaagcaataatctaaaaataaactggggtgatctggatccatctgttcaggcgagtccaagtccaacacaccggatctagtagtaggccttccattgtttcagcattctgaaaataaactgctaattttctctgtatgtgtttatacgaacacatcaagatgtcttccaaaaggacttctctttctttgtgctggaatagatgtctcggaagtagtttgtgcaaaactggcctattgctgcaccaagttactgccttcattttcgaatatcgccgccgcagatccatggatgaggctgtgcgcttgcgggaagagggcagcagccgcagaaggggtgatattcgtatgcaagaaatttaggagcacagctagagaactgtgtttttcatttttttcccctaaaatgaaaattgggatcaaggttttaagaagctataggagatgctttatggtctgtttaattgcacaagacaactttttttatttagcgcctgtttaattgcacaagacaatttttatgtagcctgggctaccatatcaacgttatacatttttttgttaaaaaaaatcgttcgaggtgggcacgcttttttctggtcacctacactcggcaaatgacgtcactgcccctcctccccgcctctgccagtgcgccacccgctcgctgggccgttgcccgttgggcggaagaaagccacgcgcgcaccgcaactggtcgacgacgacttcctcgtctctctcctccggcctcgagtcgcctccgatccgtccgagaaaacaaaacaaaccaaaagaagaaaagaaaggcgacgacgagggagggaaggctcgccgcgagatctgggggagctcccattcccagg

SEQ ID NO: 12632 - DNA, 64 bp, Zea mays
ctctataggatccccctgaagggatcatcatcctccgaacgaaaggaaacgagccgagccgacc

SEQ ID NO: 12633 - DNA, 901 bp, Zea mays
acccttaattttacatctaaattagtagttattattattattattttaaaactaaattatcttcttaaatctacatctaagttactaatattatcattaaaaatatttaaataatcataaaacatataatctaataatgtttatattaatagattaaatattgacgaaaataaacacaaacattgtaccatcatacaaatcaagtaaacggacagtggtggagctaacggccccacagaggccatggttctccaaattataacatttaaattgttatttatatttgatgaaagaatataacaaaattatcgttatatatattaatatctttctactttctcagtctaaaaaatatcgttcttatttttgcgaagttaaatattttatctccaatcaaacatttataaaaaatattaatattaatatatttttattaaatattagatagaacatttcatatacttttataataaacttatatatatatatatatatatatatatatatatatatatatatatatatatatatatatatatatatatagtctattacatcgtaagaattaatagatggttgtggttggcactggaaaagaacgtagcgcgcgtatgtagggcctgggaagaacgcatggatctgtaatgatttgtaccgtgttttttctttccagaaaacaaagattcgtgcaggcgtggagcagctgaactgcttagttattttttgacggtgtaaaggtcacgtcaccgttggcgagatggggccctaaaatggtcgtgttcatatcttcaatcattgctgtgtctatatatacgcgttcagcgcgagactacaagaggcaggcaaaggcactgcacgccaccttatctctagccggagatcaaagaagtagccgttaacg

SEQ ID NO: 12634 - DNA, 837 bp, Zea mays
caagtattaaatgtacaatttgtcttatgagagagttattatatgagtatgttttagttagctatatgtgaaatgataacatcataaaatccgctatagattatattattaaacttgctctccgtctaagatccgatcctacggccatgctgagatgtaagatctgatcctatggccatgacatgcatgctgtgttttcatgctatcatcaatagaaatttcataacattcttttcaacattgccatatcataaaaaaaacgccatgaaattaagaatagaaccatttctctcaatgtaaaatttcactttactattttatagatcaacatactaattaaatgatgcaacttaataaccaatataagtttagtagattatatgaagatgaaataaatcatttttaatataagtttcgattgatttacacgattttgaaaacaggttgatatgatttcacacacgaaaataaatttattccataaaacttattatttttaaatactatttcttccatcctttttattgtcatgtcttctttgtgatatgatattattaaattattaaatgtgaatgaaaccataaaccccgacaagccacttggcgcacgcgctgacgcgcacccgcaccagcctctagtcggccagtcgggacgaagcctctcgaacgagcgaggccacgaggtgcccgccgcgcccagccggcctcgccgaccgggcccgccggcccctatataggcaggcgccacttcctcctcgcaaccaccagacgccagtccaccaccgcttcccgtgcagcgccctccctctacgttcccccatttcctgtgttggcggcg

SEQ ID NO: 12635 - DNA, 393 bp, Zea mays
caaaattttaaactcggttggatgggtattctgtgcacaatcatcacttcaccatttgtggcggctagggttctttgtagtcgcccctggtcgggtcgcggaccgtccgcctggagggcgcggaccgtccgggcctctggcgcggactgtccggccccctagcgcggaccgtccggaccctggcagagcattgcaagttctattcctttctattgtggtgatttgtatcaactatttatctatggatgtctgtcacattattgcagtggttttggtggtctccgcaagaaacttgcaggtcgctttaaatcaaagcgtcctcgtggaggtgatgatgactatacaccgaccactgattcagaggcccaatcctcagctgggggcactgaatct

SEQ ID NO: 12636 - DNA, 936 bp, Zea mays
ctgggcgatctggaagtccagaaattctgtttgctttaataaaaaactccataatgaccccactgatgtaatcttcatgtgttgttctcttttggattactgggcactaatgcagacagggagaacaaaaaagatgttggaggcaggaagcaagcgaatcagagagacggcaagagaggtgtttaatcacgcgcatgggtgggctccggtgacaagaagtatcacatggtgaattggcagctgagagtggtcggctgtagacaattaagtaagtgtttggtaagacttagttgatctaaataaggttgtaagtctagattcctgtgtccctgatctcttttttggcgttgctctgttgggatgtagccatgtgccatccttgttgaatgacgggcttcgtgacctgtgttggttgtaaaaactctatcgttctatttcttaatgaaatagggggcactgcacttttggttaaaaaaaataaaaaaaatttggatcgggttcgtctgtccccaaaacaaccatggcgtggcttgtagcaccgaaacagcaaggtgcccgaaatgcccgatgaggcgtcgcccagagtggcagagccttgccactagcggacaagcaacacgccaagagttttaatgctagtaaccaacgggcacaacacgcgacacgaacacgagcgcgcgcacacacactctctctctctctctcctcccccactgcctttttaaccaacccccgcggcagcggcctccctccactcgatcgctctcacaatcactcaaccactgcctccagctccagcagcagctagctcagctcgatcgtcctcccgacccgatccatccaccccactccccgtgctccaccatctcggcatctcgctcgctcacttagctcgagctgcggcaaacagccggccggcagtccggcacacgggag

SEQ ID NO: 12637 - DNA, 754 bp, Zea mays
tcttgttcaacgtggtctccctcgccgactgggacgacgacggctcgtcgtcaggcggcggcgccccctccgtcgaggcgggaatcaagaaccgtctgctggaaggcaacgccgccagcgacagcgacgacgagaaccccgacgccgccgccgtcaactctgacgactccgatgccgagccgccgcggattgcgtacctcctagagggcacaaagggggacggcctgcggatgcggcggactctgcaggccttcattcgagtgctctaattgacaggcggcgcccttcaatcgggggctcttggtcggaggtagcggcgcccggcttccgcgcgaaggataacgcgacgacgatggagaactcacggcgacggtgctggcggacggaagccggtgtcaacgacattaatactggtctgaacctattaacgaagtcttcatatcggctttgctctgcattttcataacagcgaaactccatttcatcgaagccacccccgtcgtgtttcataatagcaaatttctcatctctctctcgcgcgccctgcgcattcctcttagtggcggcagcgccaccgagtcaccttgccgccccagcgtgcagctggggtgtctgtccacgacaaggcgtctgccttgctcgtagcgaaccagcaaacarcgaggggcctgtatgggagtcgcggtagcaagcggagcgcagccgagccccgaacagagtctcgcggaagcgaggaaaaggagggaggggaacc

SEQ ID NO: 12638 - DNA, 694 bp, Zea mays
tacgtcaaatcttagctcgacatgggattttcgttaaatgtaatgtctagcatttttctgagtcaattttgtatttcatattcgatgttcaaccataatataacatttttttttgctgaaaataacgaaaaatttaaactgaaccacgtgacctaattcgccataatggacatgtataagacccaaacacgacacgataatcaaaccggatcgacatagacctggtgggcaacgtcatgctatgtttggatcgatccaaaccgctgctcattgtaaaggcttggaatgacgtgtttgaacaatattcaaaaaatgtgtaacgttttgttagaaaggttaacacatgaaaatatacgatgttcaaagatactaaacatgtatctgatatgcgggctcaccattcagtcttctctttagtggatcgtgcaaaatatgatacatgacactacagatcacacaaaaaccaatcgcgcaacctgatcccgctcacatgttgaccgtacgatacgaccgaagcagccgcagcactcatcgtgacgcagatcaagcaaaccctaactgccaacgctactataaaatgtttttctcgcctctcctcgctcccgtagccgccgccggcctccaactctaaccccgttgcttccggctcccgcagcgtcgccgaccttcacagccggttccttcctccgccacc

SEQ ID NO: 12639 - DNA, 1171 bp, Zea mays
gttatttcagtatcaattttatctcaacccatattaagtgggtatttgacatggctttgttgcattgtagaggagctctgttctaaaactctaggtggagcaactatgctcaggagtttaaaatgctttctcataacaatagtggtggctggtaaatgcctttaaactctgtgtctagtttgcttttttaggactatagaacaataaaaaagatactctaatatactgtaactctaaaaacttcataaaacttacaattgttatggtatttaactagctctagcaagcctcttctagagctatatgctaaacactccctaaatgcaggagttgcaggagtgggaagtcacctatcttcaatagtggttcatgagctggtcggccgcgtgactgagaggaccaacgtatatatgcgtacatacgtaggactatgggytgaacaaaacttcacatgcgcatgggtatctagggttgtaggggtggtaatgaactctaaattttatactacagattttaaggattaaatcgaattaggatcggtttgtattcatattcatttttgaactaaaattatttaagtgtcttaactttgtgaagagatatttggatcatgatccattatcatacctatgcctatcaagtggttggtgcacacaaggtaggaacaacatcgtggatagaacacacaattaggacttccacttagaggtggattgaggtgaattagaaaggattaaatcccttcctataggtctcctgctcagtcagattgttcaagtgccatgagcttttggtcacataaaagcagcccggtgtgatgcaaagctctggtcggcccaattacccccttcggccacttcgggcaccaacacctctgcggctctgccgtcctatcgaaaaagaaaaaaaaaacaaaatgaataaacctccgcagaccacgcccaccaacgcccatggcccaggctctcgggcacgtcagaggcgatcacgacgcctgcacccagttcagtggtccaccatcatcgctcgtgtcgtgtgctcagccgcagccgtgaggatccccagttccccaacctctcttgctcgctcccctcccaggctcccacagtcacacactcgtctcgagcgccgccccaaacccccaaccaaaccctcgccgccgtcagcggcc

SEQ ID NO: 12640 - DNA, 131 bp, Zea mays
cgaaggcccaagactccttacactctccttttgtcaccttctcttcgttcccctcctcggctcctcgcgatccttctttactgcccgagagttctgactagccacatccagtcaagcagtaaaggcgcacc

SEQ ID NO: 12641 - DNA, 476 bp, Zea mays
cgtaagttctcacctcgaaatctttgcttcttttgtgctagtcttttgttgcgacatgtttacgttgagcgttttgtccggtgactacattgtcaagtcgatgccgcatcgccttccgtagccgtcgttatccgctgtgttccactttctctggatcgatttcactccaaccaggtttttcgttgccgccggcgtagttgggctcagaggagcagagtagatagaggggaatggtggccgacgagaggataggagacgcggtggagctggaggacaggagcgcagcgccggctgctatgtggagcgcggttggtgccggaggctagggcatcggttcctagtgcgtccccctagtgcggatgatctgagagttgcaatggagcagccacttacctattttctgtgtatagagaattgtattcatataaattgggattgctgctccaacaaagggaggcgatctaacacgatttacc

SEQ ID NO: 12642 - DNA, 61 bp, Zea mays
ccactactagaaaaatgtcggctagaaaccgacgttcttactttaatagatcaacgttctt

SEQ ID NO: 12643 - DNA, 470 bp, Zea mays
tttagaaatactaaaatatttataatttggaacagtcttaccacatggatttaacatatcatagtgatgtttgtatttctgtatctatgttttatactaaattttaactcccgtggcaacgcacgggcatccacctagttttattataaaaaccataatcaagggcgtacactctactgatttttttggtgttcggaagtgacaggctacgcgagggtttgcaaattgcaagttccaaccgcgtgcacgacagtgggcacgccgcacatggggccccactctctgaaagtgggcctatcctcgctggctatacgtctcccctccgcgcacaaaaaccctagcacgcaggcgcagccagccctgctccaattcccaaagcttctggaaaacacctactcgtctctcatcccttccccgccgtcgcgtcctcttcgaagttcgaatcgaatcgcgccgcgatcacccacctc

SEQ ID NO: 12644 - DNA, 1500 bp, Zea mays
ccttttttttactatcctatcttaaatatgttagtgaatgtactcaaatatttattatactttcaaagtttaatttttaacttttgaaatgccaatattttagtattaatatttattttagttttaggaaaatatcccttcaacagaaaataaactattattgacagacaattccactcaagtctttttggaaatcttatgtatcccaaaatagaattttgggtattacagcaaatccatattcttgtttttaacattgagcttgttaagctttataaaaagtaaacctcaaattcgtcttatatcttctcaaatgatggatataaaattcggatacgggtaccgattcaaatgttttttcacctttttcgttgtagggagcaaatgatgcacaaaaaaatatacaaaattttattcttattttaaataatgtgcttaacaatataactaaagattagcacactaatccacgcatatatatatatatttgaaaaaataaatttatcgtataattcggatgttcaggatccatccctaactgcaagctgcctgtttcctgtccaaggtcatcaaggcttcagacatctttttctgtgttgtcgtcaagcgagatgtggatgcttatgaaaattctatggaactcctattttaatcctaagaagttattgattccgttgagaaacagccagctatctttttgtttgtcatttaagtttgagaagtgttattttttatttgcacttacaggatttcaggaaagaggcgtagctacatgcacttaatacatttaatgtttgatatatatacgtgattccattgctccttggccaccatctaaaaaaaagaataagtatatagtatgcttttgatatatagtaaaaagtcacgaccttctgctagctgaatgctttaaacatccagtaaaatgtttttgatatacagtacaacattgaggtgactatcgaaatggtagtgcctgcctagaaaaaagcaaagcaaaaaggaaaatggggaaaaagtgatgcaagtatgcaaccgcattctgttttgatgggaagaaatgacatttcagctgaagactgaaaatgaatgtgtgaaggaaaagttgttaatgggaaaggacataagttgccttaagaacagccgagcgtgttctctgagggctcttttggcatctaatcacttaagagtgatggaagttcttgctcattttttaactaaaaagatcatcatctagtctaatagttttgcataatggggattggggaacaaataaaacctggtataaatcaggggtgtgtaagactaatagatacttgactgttgagcccatgtaaccgatattgattcatctttatttctttgctgtagatttcaaggtgctggtgaatctggcttggccacatagatcttttttattgttgtcctcagaagacaggtttgctgagactgctttctgttgtctactgtaaattgatgaaattttggtgatcatatact

SEQ ID NO: 12645 - DNA, 368 bp, Zea mays
gttaatttgaaaatatgtgagaaattatttataaaaaggtaacgcgcaaagatagataagagatagagatataaccatagccgtgaaatgaaagcaactttaatatactatagaagagatatatatagatataaccacaggggtgaagtgaaagcaatcgggcgattggacggtagcaaaaaatttcatcagatactccaccgataccagctgcagtctgcagaggaagaggacagaataggataggatagcccctgttcttctagcctgctagtctgctacactccacgtctctacctctaccgcacattttgctacgctccagctccatcgactatcgagtgcttgctggacgccggggccgggca

SEQ ID NO: 12646 - DNA, 1500 bp, Zea mays
ggaagggaagagagagaatattattatatctgacgatgagctttgcgttgggtctcaagcgttcaggtgggggctttcagagtggcgcacaaactgcgccttggcctgtggcggtgacaggggaatcaaggaatctaatccagatctcggcgcgcgaaagcaagcgaccaagcatagctatcgcgacggggatcgaaaggaagcttctgtccaaagccccgcctcgcctctcgcttgctgggagggacacacgaccgattttttttattttagtctcttttttaaaaaaaataacatttacttaacgattatttcttattttggactctttatttggcttcataggttgtggcgtcgagccaacacagctcgacattgtagcctgtgacgccgaggtctgatgtggtaacgtcgtcaagtgttgacgagacgtcgacgtggccctagctcggcgtcacagattcagatagagacaattctgacaatattttttttgtaacctaagaaacaagaagtgtcgttatgttataaaacaggaattytttttggtgtatgttatcgtctttccattaaattgtttccatatacttggacttggtcgcagctgctctgatcgaggggagagaattgttttcgctattactatcaacataaataactacctgtgtaatccaataagttaactgtttcaaaaaaattaattgtttccattaaactgttttcatctatttaatctaagttaaccgtttccattacttatatataggtytacatggttccattaaattgttttcattaactgtttcattacttatatataggtatatataggcatatataggttccattaaactgttttcatctatataatctaagtttatttacttagtttagttagtttagttacatagtttatttcgttttgcttagtatatttagtgaatatagttagatagttacttagttgttagtgaatatagtttgatagctacttagatgttagcctcgtgctgttttctgtgttgaaaagtgtggatgtcatccattgtgttgttcgtttctctgcatgttttagaaacctcatcttgtagtggaggtgctgcataattttttattgagactactatgttactttttgtagatagaaggccgtccgattccaccatctccgccaccggtagcttgactacaccgcgaccttaggtatacctgtttttcacacagtattaatcgattatataactacttgatgtgattaattatttcttagtatatatatagttagtattaagtaattagacaatatcagattagtaagtatataagtattagtatatagttataagttagtcattagctattacttatttattacttagtaagtatttaggtattagtagattagcagatgtggatagtatttagttaggcattagttgatagtattagtcatgtacaatctttaatggttattgagttatgaatccatgtttgcaatag

SEQ ID NO: 12647 - DNA, 548 bp, Zea mays
ggtaatgcaatggcctccaaacatctctgtgtgtacatacgtacgtaccttgacgatgttgagttgtttacacgcatacgtttcttagttcttactgtactctccatgagaacttggaacagcttttaaaccttttttttatataaaaacttttaaactgatgctatatttgtctctgttccgacatgcctgcttgacgtaaacttactggtccgttactgatttcttgcaagtggcagctgactgacctgccatcttgcatgttctggtttaatagcaccagagttttcacttgcaaaaaaaagacatatctaccattttccatgttcgtatcatggttgggggcaattgcagcatcaccggctaacaggttcttgaaagttttttttttactttttacggtgatcgtcacatgacatgttttcttttcgaaagggaggcaatttttgtattgaagccaaaaacaatacatcaaagcaattggtctgaatcaccattgagagtgtcaggaaggacatttcctgcagcacgcggaaggtggccaatgc

SEQ ID NO: 12648 - DNA, 1484 bp, Zea mays
gccatgccggcttgtgtagattggcagtgatcgtcagcaacatcggctattcttcgtacgtatagatggaaaaggggggaaaatcaaaatgtgatgttcaagggaaagagcaaaaggattgggctgcttcttcttcattgtcgttacttgtctgaaccactgtcaacggctggattattcattgttcaactgtcctaattccaacagcgagtacatttcataagaggttcctaaatttacaaatttaaataatagtaggattatatataggaaattgtaactagactaagtcctcttttttcttatgagtactaagttctaaatttttcgtgtctttgtctgagtaggatcaagcatcaatgcatcatgcgagtattcttcctgagaaaaactatgagatactcttcaaatctttaagtaatatatacaggttgatggtctgttgtgcaatttcttttgaagacgtccgctgaggatatataacccgcagatccgagtataaaaccaactaccctgatttgattatagtgtcttagacatcctcatatgtggtaacgagtaataatcagtggtgggtgtaggattttactatagggtatgctatctcaaattttcatatatattcgattaagcatttaataatttagaaataatttttacatcaaattacagtaaattttaaaattgaaggttaagttaaaatataaataataagtcttaaatttggaaagtaagttaaacatattcataaattataataaatgaaaagtcatgcggatagttaaacgactttttagctgagatcttctaagagacataatcaatatcttaattatgttatcttcatccacttaaaaacatattaccaaagaattaaataaattatatttacacagattaaattcttagttctaacgggtgaaatgtgattataaacaattacataatatatatcgagcttacattttttaagatgaacgaggataccataacttatgttagaaaaatatgttaataattttgaattattattttatatttagttttgtaacaaagttattacctgatctctcacaaagttttccctttatttgccattttttttgaagattactgaatagtgaggtgcatgcgtggtgtggccgtaccattttactcgtgcgcactcggtctcctcctccactccggcttcggtcttccgttcgaaatccaaagcgagagtctcacagtcggacaacagcaccacaggccagcaagcaacaacaagagcaggcgggatcgggacatcggaggcgccagcagagcagagacaacaacgccgcgtgcggcgaagtctacgaggaaactgaggaagagaagctagggagcgaggcgcgcagcagccagcagtaggcgacgagactgcagccagtagcagagaatcacactagccgatcgattcgagtgcacccacgtcggaaggaacaagtgggggcggagccgcg

SEQ ID NO: 12649 - DNA, 1500 bp, Zea mays
ttaatggccgaccaaatttattaaaaaaatatttaaaatatccataaaaccaaataatcatattataaaataatattttttaaaaaaatttgtctaatgagaaatactgtagcgatatttgtagctttgaaaacctatacatcccaaatccatcttctactaggggccgaaagtggtgacagatgccgatgtcagtgcagaacagcacgagttccatccaagcatgtgtggtattctaattggataaagaggcgtagtggtgctcagaaaaagaaaaggatgtgcggcccgcgactttccgattccaaccaaccactcctgattcctgaacctcaagtggagtggggagtagaagcatctcccagcccccgccaaccatgaaagctcaagctccatccagcaacactattcttccttgaatctggcttacatcacactcaaaacacagtgcgcgagtgtatgcgcatttgtcttccaggttgaaataaaaaggtagttcgatcataggtttggatcttggagctggtccacctccatcatcatcagagctgctacggctgctacagtatacatgacatgtagcctcctacttggccatcagggacgacaaaatgagggggccatggtaggtgctcctacctccgggggttggtggtcgacatgctgccaatacaaacaatgcaatagccaataggtttgctttgcttctccagcttccaaaactcgtcctgcactcgtgcctgggaaacgaaccatgcgacgccagttcagtcttaagatcattcagaattagcatacggtcaacgggtttatgacgtttcaaggacgatgacaatgtcaaggctgctaatagtttttggattgaaacctgatcaatgcggtttgattttacctttggatcttgactgggctggttttagaatctgaatacacgcattattcaagtttgctgctgctgctaaatgcattagttggtgctcagtaccacgctcttaccacttaccatcatgttattaatcagacaaaagttgacctccctgacatgccatgggtctcaaaaacaaatgtatctggctgacgcgcatgtgtcagcgagcaacaacacttaccaatcaaacgaaacagatctatctatacaaagtttcctcaacacccccgccgcaagtcgcgggagaatgaacatgatcaaagaatcaattttgattttttttttccagcaacgaaccaaccactyttccaagccaagtccaatcaacaaaggacctgtgagctcagttccaacaaatccctttccagcaagagaaaaacagggtacaaaactttggactgttgaaagcagttcaccagcatacaactcatgctgtacacaacatagctaaccagctacacacgtgaactgaccatcagatcgaccaacctcaccaggagacaacaaaaaagggaagaagattaagtaagttcgatgtttgtcattaggttaaataagtggggcttctaagc

SEQ ID NO: 12650 - DNA, 1458 bp, Zea mays
gttgcagacatccaagaacttgtgaccaatacttaagcatgtgaagtcgtacggccaaacccacataggcaagatacacctaccttatcctttgatgtcgtctttgacttagtcctccataaaatagattcccaacttgatacgaccaaataaacttcaattctttatctttcatctctgacttcatcattgtcaatcgataaaagatattgagtaataagtgcatatagtcaatcaaaccaagtgaccatatgtacttgatcatccaaactgagtgaactcgaccatttgaccaacctgtgcgagcgactataggtacttggacgaatttgagtgtcaataggtggaaggtgaacataaatggtgccatctatatcataatagagcaaaacattgttttacactgtagactgaactgtttatatagtggaatttaaaatgagagatgagaataaataagttgatagaggtagagggatcacagtggccttgggctacttagtgcctactatgttgtgttgtaggttagagatgctgaagaagtggagtccatgaccgtcaaagggtttttttgtcttgttgatgaagaacgtgatgtgccatcggtgattcaaacgtatagtagctcagtttgttcttttatgataagcaaactgcttgtttggctttaatttggctttaatttgaaacggcttttattggtttatatagtgttttgtctctataaattacagcagtccgaacaactgattttaattcgagagcgagaggtcttgcgtctcatagtggaggaggttatgcaggtgagataagttatccacacaagagagggtaattatgttacccatgaaaccacacgactagctttaagaacgaatcatttagccatttgacgtcacagaatactagtttgtatcgagcatatacttgttttaagaaataatgaattctctattttttctaaaaaaaagtaaatacagaagaaaacaaaaagggaaaaatagtaaaatacaccactatctatctgtccgtatcacatacagttgaacatgtcttaaagacgagacggtggtggccgcaacggcagcccaaagcttagaccctcaacggctagttccccagaaaccctcgagtcccgtcaatcccagccgtccgatcaagcctgtctagacgttgcggccttcctcaccgtccgccatctcccgagttccgaccgttggagccgccccgtccggccccgccccggataaagctgcagccccaccgccgtcttcttcctcaccaacaccaaaaggcacaagcctcgcccctccctccctccctttccaatcctcagaaccaataaaccgtagacgagagaagttacgagcttctccttgtcccgtgtcttttcaaggatagcccgggcgcagccgcagcatttcttggcgtcggtgtccgcgggttggcgactaagca

SEQ ID NO: 12651 - DNA, 280 bp, Zea mays
actgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgctagtttgggttgaaataatggacctcacaggtgcattgc

SEQ ID NO: 12652 - DNA, 296 bp, Zea mays
agctgagagagacctccagaccacggcctatgcaaccaccgtgctaatggcgtagtagtactctagtatagtactagtactgtatgagttggtagtcaaagctgcagcctgcagcagagagcggtgcagtagcggggaactataaaccgccggcgcattcttgctggtttctttgcagttgtgcatatttaggagcgagcaaagtaaacacaggctgcctttttgtttttgtttttgtctctcccacctcttcgaaccagtagactactactgctactacttgtgtctatcagtct

SEQ ID NO: 12653 - DNA, 107 bp, Zea mays
tcttttcatcaaagctttttaaataaaagtaaggaaattatgggatttctggcgagacagagaacctcctgtcctgtccccggcacagtgacactgacagtagctcg

SEQ ID NO: 12654 - DNA, 1500 bp, Zea mays
cgtcagctaaccaacaggcacgcactacgctgtatatactagtactagcgggctagcggctagctttagcggcgaagaaatttgggtgacgctgcactgcaccgcaccagcccaccgaggaaacatcgcgcgggcaccaagcagtcaaagatgagaaagtgctccaccccaatctagatggcaggttgcccgagcgtcccggaaggagcagaggactccatccacggcatgggacgggacgggatgggatgggatgggacgggatgggacacgcggggttgttgggattgacctcgacgtgattggaacaggacaggatcacaggactgaccttgtagcggcggtgccatctcgcgcatcttgcggacgccggcgggtggcgggtgatgaagacgaggcccggattctagacccccgtcggatcacgcggcgccgaccacgacgagcgccccggaggcggaggcggctgcggactccgtgtctccgtcgacgagggtaggaccatatcgcctcgacggcaacggcagcgcggttctcgccgacgtcgcttccgtctccggcgagttgcacggcccacgcgaagcacagcggcagaggtgggctgggccgctgccatcgccgcctccaggaaaatgggctactcctctagcgagttaaatcgcattcaaagcttcttcagagctaatttcgcaaccctatttttataaaagattttcattttcctaaataaaattagttattttttcctttagaaactagccttaaaagcttaccatcatctttttttatcatatttttttctatatatactccgtaaatacgcaaagagatcataaaagtacttttgtaaactgaatgtttggatagcatatgaggcccgttcgattattacggattgtttagctgaaatagttttctctaatttatatggactttccagttgtaatccgcacaaacaaataaggtctaactggagagaaaaattccaaattagcattcgctgtccagatgcaactgataacaagcaccccaaaaaaaggcacagggttgatggtttcaagcgtgcatcagaaaccaaaaagaggcacaaccttaacacaacagcagcaacagccttttagtcctttacagacgctgctcgtgctccagttcctggagttaaaatcagatccmtgcttcgtttccaaccatcttctacagtatcagaacagggcacatggcacacgcatatagatagatagatacacaaaaattgggagcagctgatggtgaatgtgacgcagctgcggaattccctttgccggctgctctgatctgacgggggcgcggcagcacttctacttcgatgaggccttgtggagcttgtcaaacgaagggtgtctcaggatctcctttgctgaaggccgcctcaccggatcagggtccatcatagactgaaaacagacagcgacagaatgtgaggctatttttttcacgtgttacttgacatgctacaaagaa

SEQ ID NO: 12655 - DNA, 95 bp, Zea mays
aatggttatgaattagtgactattcaacaaaatattataggaaagttttattgtcaaagttccactttgcacagacaaactatgctcctatagaa

SEQ ID NO: 12656 - DNA, 350 bp, Zea mays
tacggcatataataaaataagtttccagggccctatttgcataaccttgtcctctgtatccgtgctggtgctctgcttggtctcggtctcgtcaccgccacgccggtctgccgtcgtctcgtctgctgcactccactgtccactccactctcccaccgcactttcctctctcctcccctgttttcgctcccctcgagacccccaaagcaccgaaagggggaggagcggagggagatagagaaagcggcggggttcaagaacgccgcggccatccggagccaggattctcccgatacaccccctcgttcccagttcttcagtggcgccgatttggagttccagagacggcg

SEQ ID NO: 12657 - DNA, 595 bp, Zea mays
gtctggcaaagtgtgttccatccgagcggtgatgtgagatgtgtcccccctgttcttcatcggtttgcttgcaatgattgagatagatgtgctcatttgccttgcagaaaatgaaaaataaagatatctgtgagtatctgttagaggtaataattgtatattattagggctaaccctagagggtagctatatagtgtttgtacatgggccacatgggcctagccaaatgggcctaaccacatatactataacaccccccgtagtctgaacatccgtcgcagcggagtttacagactggatccgaaaacaagaagtacatcacacactaggatccccccacagactcaactagccactactgatgttgaggctagagcgaaactcggtgatggtcaaggacgaaagacccttggtgaagatgtcggcaaactgggaggtggtcaggacgtggaggacccgaacatcaccgacggcgaccagatctcggacaaagtgtagatcgatctccacatgcttggtccgctggtgctgcaccgggttggtggagaggtagacggcgttgacgttgtcgtagtagaccaacgtgctcttggag

SEQ ID NO: 12658 - DNA, 1049 bp, Zea mays
ctctctgttccttagggctcctttggataatgaatacccgcagggatcccagcccaatccacgggggaatgaggctcgtgtgcttttcttccctggttatcccggactaccatttgcatgctacacaggccaaaattgccacgggcctttttcacctcatccctgttaatccacggggaaacaaaaaaactgctctggcctcgtgtttaccgttcccgtctctctgctagtttgtctctgtcgcagcagccatggcggctagggtttacgccgtcggcttccatccgtaggaaaaacctcctcatccagtcgttgccctccatccccacatgcccacgctgctcgtcgcccctctccaccaccaggaatcattcagttcacctgatccagcgcatcgcatctgcaaccgtgcgtccagttcctgctttgctcagctgacgcggtctctgcagtagatcaggcctgaggtgagctatgcttgtcgcatccttgactgggctcacacgcaaacactacagttagtacactagtataaccaagatgtccattgatgtgatagaatttgtggtgccgtctcaagcagctgcatgatttctgtgatttttggttctgtctcaagcatctgtctgatttttgtgatgattggtgacatctcaagcagaagcagttgcctaatttttggtgtcgtctcaagcagctgcctgatttttgcatgtttaaataaagggaaatagtgttctcaggatgtagattagtggtgataatcatcatatcatttctgattcgtttacctgttatatatatagtttcattatttattttactttttggtgaagctagatatagaaactactgaattgacatcagtttatctgttttttgttcttatatcagtttacctgtttgctgtgctgttacatgtttttttagaacatgcattatatttccatgtttgtccaaacagatctgatattagtagctcaataatatttatcttactattttttaagactataacaaagttatgtattatttgcaactcttagata

SEQ ID NO: 12659 - DNA, 151 bp, Zea mays
agtcttggctgtacacagccaagctttttgcacctcttttcttttcttcttctttctgtttctaacacttagacaagtatattagtacacaaaaccaatgtactaaggcttagaaacatacctttactcatgatttgcactttgttcatcc

SEQ ID NO: 12660 - DNA, 129 bp, Zea mays
agtcttggctgtacacagccaagctttttgcacctcttttcttttcttcttctttctgtttctaacacttagacaagtatattagtacacaaaaccaatgtactaaggcttagaaacatacctttactc

SEQ ID NO: 12661 - DNA, 1093 bp, Zea mays
gcaataccgctcgcacgctccccgcctatccgcatggcggcctcgtccggctccggcgccagctcccctgcctcggcgccgccagctgccgtggtgcgttccccgtcccccttcggtgctcctcctcctgccaccctaatgcgctgtgctgcgttcaggcggctaatcgtacgcttgtagctgtaatctctcaggagtagatgcgtgcttgctgaatcgatcagggcgttgactcaatccagtgggtagtgatcgtgccaattgccaattgggattggcttcccatgcagccaaaaacggctgctgtgctctctagtaaaatcgtatagttctcttctctatgctacagcctacaatcatctactctgtataatgttgtggcatgcggaccgaagctaagttctgtgttaactctcctggactgcttaaggttaaatatgcattagtctgattgctggctgtaggaattgtttagtctgcatagccaaaaaccttaaactgcataaggttaaatctgcataaatgccatggctctgcaatgtttatttcttgagacatataacgatttaactggcattgcgaagaaaaaatgttaaaagactcattctcagaaaaccattccttctgcactgggcacggtaaacctaccccctctcttctgttggcaacgacgtgcatacgtgttctatgtgaagctgggggaagaattattagcctttcattacagatgtcggctgttgatggttgctgtgcacgttatattacaacccaaatacacagatcagcaacgacaacactcgtcatcataagcttccctaggtataccacatgcatggggaggagcgaagaccaagctatatacccccatctacatgcacacgcaagattaattcgagagggcactcactataaataggacgtgagacgctctatctcacagctcgagccacgacgtcgtcccgccagtcgcaaaggaaaccctagctagcaatagcaagtctaaccagctaacagggacagctcaatcgacgatcttgtgctaaagtactcgtgcaacaatcgtcgtcgtcgtgggagctgatcaggccacgcg

SEQ ID NO: 12662 - DNA, 151 bp, Zea mays; identical to SEQ ID NO: 12659

SEQ ID NO: 12663 - DNA, 273 bp, Zea mays
ggtaagatcgatgcgctagcgctagcctcactttcctcaacctcaagagctaaatctaggcattctgcattcctgtacgtacaactaatcggacgatttgctcctcgatcagtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacaggaaggcctgcctcacctt

SEQ ID NO: 12664 - DNA, 506 bp, Zea mays
ttcgaacctctgatcagtaggggggctcggggcccgtttccttcgcggtgaaggatccctttcggggtatccccctttcccggtccctgttgtaagagagagaaagaggaaaaggaaaaggatacgaaatcgaatgacgtggcgcaccttttttgacgcggtcattatggcgaaggcgaagcgtcgcccgcttctcctgccaaagttgccgcctgtcccgccgcagagttaatgcgacgggacgagtggttcgcggggcagccgttgcgcgtgcgcgagccgttcgaggaacgggcgtttcgctttgagttttgaatcccacggtgggttcaggtgacgcgttgaacgggtctcgcctgggtccttatatattcgggagagggtccggtgatggttctttgctctgctacttgcctccttcttaggttttcgcaacccgaggaaatagccagagaaagggaaaccgcccacccagtcctttccgccgccacctcctctgcttggtg

SEQ ID NO: 12665 - DNA, 734 bp, Zea mays
cagcgacagcagctatgcgagggggatgtgcccagtggcacatccactggtacgtccatctcgatccacctggtgctttggtttttagtactccgttcttgagccactgcttggtttgcttgctcctattttggttggttaggaagtctagattgcttcgacaaatgcatcgtcttgctatgttatgtgtaatattttctctgttatgagccctggaatcaaaatttttctcctgcgtctgctgccttcctccatccagttccttgtggatttgcttcttgtgtgttgttgtgctaaataatacctgtttaattttgcattttttttggggtagccaagttctgctcctgcgcggtatgtttcttcgtgctatcatagttcatgaagctaacttttaagattttaaactggcagccttatcrgtacagttggtacctgattgatgttttataagcttctaacagacgaagtcatgtcaagttttgttatatttgtgggtccaccaagtagtgttagtgtctggattacttgggatgagctagtacctcagtagccaaataaatgcctactcctttacttttttttcctctgtaacttctgtttactcatgctgccagagtgacagtttagtttatctaggtagcactagtttaaggtttgtttgaactaaatgcatttgtcatttacgactaactagtcacaatatgaaaacgtggtcaatgcaggggcttgtc

SEQ ID NO: 12666 - DNA, 1130 bp, Zea mays
cagcgacagcagctatgcgagggggatgtgcccagtggcacatccactggtacgtccatctcgatccacctggtgctttggtttttagtactccgttcttgagccactgcttggtttgcttgctcctattttggttggttaggaagtctagattgcttcgacaaatgcatcgtcttgctatgttatgtgtaatattttctctgttatgagccctggaatcaaaatttttctcctgcgtctgctgccttcctccatccagttccttgtggatttgcttcttgtgtgttgttgtgctaaataatacctgtttaattttgcattttttttggggtagccaagttctgctcctgcgcggtatgtttcttcgtgctatcatagttcatgaagctaacttttaagattttaaactggcagccttatcrgtacagttggtacctgattgatgttttataagcttctaacagacgaagtcatgtcaagttttgttatatttgtgggtccaccaagtagtgttagtgtctggattacttgggatgagctagtacctcagtagccaaataaatgcctactcctttacttttttttcctctgtaacttctgtttactcatgctgccagagtgacagtttagtttatctaggtagcactagtttaaggtttgtttgaactaaatgcatttgtcatttacgactaactagtcacaatatgaaaacgtggtcaatgcaggggcttgtcatggcatccaaacgtatcctcaaggaattaaaggacttgcaaaaggaccctccaacatcatgcagtgcaggtatgagctcgagttaccaattgacttgcgaatgatgccacatggtttgtctctgaggattgatgcattttgttacacttatgaatactaattgaactgttatagggtagaagctcataatagaaaatctttattgtgctatagaattttgtcatgaacttatatacgacctgtactttgcgtgatttttttatcgtataatacgattgattttttctgtcatagatctctgtactttgcatgaacctaagtaaactggaagaatttgctggaatggttctctcaggaattcattttggaatgtttcgttggaaaataaattatga

SEQ ID NO: 12667 - DNA, 1500 bp, Zea mays
gtaaggtgacgttgaaaacctgggcggcaaacagttgctttttgggtacaagttcttgcctctcccatgagatagggagaaaaaaaaactccggcttctatagaacggttgttaggctcagtaccgcatcgagttgcatgtatttctctatttgcatatagcagattttctcgtgatatgtgcgacggctgtacgtgctgttagttcttacaaggaacaatggccaaggaagcgccaaaattactctagatttaataaccagctatttcagatgtgcatacagtacaagttacatgatgaacacagccactactaggggtggatatcgagccagctcggctcgttatggctcggctcattatagctcgttactgtaacgagccagctcagctcggctcgttatactaataagctaaacatctagctcggctcggctcgtttatgagctcgagctacctcgtttagctcgcgagccagagtagaaaaaaaataaaatgaacataataattatttttttgttaatttcaaactaatttaacaatagaaaatagtaattatactcatggtttcacaaaccacgtcaatataacaccaatttagcacaattcatcactcattaattcacaatttacatacatgttcatcagtttaacccataattatatttgcatagaccaaattaacacatagacagttcattaatcattagtttaatccataggtcatagacacctcacatatataaaacatgtttatcaattattctataaatgatatgcatgtagttctgttttgcaggaatatggtagctcgtttagctcgcaagctggctcgttaacgaaccgagctaggatgtcagcttagctcgtgaaaaaattcaaacgagccgatctgagccgagccgagctgatcatgaaccgagcgagctagcgagccacgagcatttcgtccagccctaaccgtgatcctacaaatgaccattgaccacagccacttcaggccgatcaagtacagcagcccagcccatttggcccatctcaaccgaaggaggcaaagacgcaacgcgaggtctcatgggcgaccgggccattcgtcgtctccgttgtctttgttgcagatcggtgctcctctcaccaccaggccgccacagctcgccggctttcccctccctgccatcgagcaccacctggtacgctctccgcttgatctccccttcctgctgcggagccgtgcgagcaaaccttaacgtagtccgtaggtacgccctccccttgttcttcccttcctcctgtgcgaaaccgtgcgtccaaaccctaacatactattcgtactcggacctaaatctaatgacaagtgtatatgcatgcattacgcctacagccaactaacttcgattgctctgcaaaaattatggagtgtagtgtacatgtgtatacccatgtccttcactgagtccacccctgcttgacagagcaaacagagcaaggaaatagtttaaga

SEQ ID NO: 12668 - DNA, 883 bp, Zea mays
tcccgggtcaccaaatcagcccttagggatattttggtcatcttatgatccatttaatatgttttgaatatttttaatccctaaaaccaaacagaatagggactaaactttagtctcttaactaaactttagtcttttaactaaacttcagtcactggactaaagaaccaaacggtcctctaatggcttttgcagcacgtatagtatagtaccatctgtagcatgaatagtatagtaccaacatctccatggcatccccgtgttcacgtatgttacttccagggctagctaggggaactggggtggagaagacaagaacaaatgccttaacaaaacagagtcggtctacaaacctgggctcaaagctgcaactacagactacagcttgatggccaaggctaagtactatttcaaacattggagccgaagggcatacatgttcagacactgaacacatcactaaactgwttcaccaccgcaaggatgggtaccctacggtgtacaagaaacaacttgtggatgaaatacgaatttcagttttttttttcaaaaacttttttggtgaaattcgttgtttttagaaatggtgattaattttgaaaaaaaaaatcgatcacagttttattatatttttttcaggaaaatatctagttttattatatatttttcctggttttctaaatttgaaatacaatttatcgaaacgtgaccgaaaattgtttctggtcagtatagagacaaattttaccggagattggccgaatctcgtctgtatcccacccctctcttttgaccttgagctcctagaagccatccccaaatcggcctacgcccacggttccacctcctcgtccacgaggtgaggaaaccctagcgaccgacc

SEQ ID NO: 12669 - DNA, 1500 bp, Zea mays
actagttgtgaaagctggattcgctccaccgtaacacgtgcgataatgtttatcagcttgtgaagttaggatgcaataatgcaagtatatgctgctttgcttaggataagttcagatgcttttccatgtccgcacggcgtgtgcaaaaaagaaagaactgaagaaaacgacatgcaccaacctaagatatgcctagaatatttaccatgacttacttgatagtattattgattgcctcggccaccaggagcgaacccatcctagatagaaggttgctaaaatgggtctttatatttacagtaaataagataaaaaaatcactaaaccaaaaaaatcattggaatgcaatttcattggaaagccatgtccctcttgggtgccttcgtcttccgaaggttctcaaatacacggctaactatttatttttgacatattattaagtgttacaggagtttcggtaccagaaaaacttcggttttgatcaacggaagcgcgacgaagcaagcttcgttactatgatgcgggaaggtgacgtaggaagaaggtgttgattcaaactgctaggtgcaaatgacaaaattgtccctatgacatttgtaaaccttgtacataatctttgaggatatgaatgtaatattgtacgaagctatacgattgtctataaataggtgaacagtatcctcgtactgttcacgctggattataactgcattcacgcctttaccttcaagcaagccgaaggtatcattgcaatgtgtgttctgatattatttgtacattcaatacgaaatgaataaatggcatgatattacatttgtgattatgtctttatatttttgagtgatgaagacctgttctttataaccttcgtctgagattcgttatatccgaaaggggaataatgcttcgagggacgaaggtttttaacgtttaacaaatgtgttgccttgttctttattcacaacaattgaaaacaagtgaccaacattggcatccacctccggtgaactcaaacgaccacctccgtcaagccgccaaagaagatagcggcgccaggggctgcccttgctcccctggacaccaatcaagatgggctccttttaagggaggcccgaagccagaagaggaaagctattagcccaacaccacaggatgaagagttggatcaagagatcagggatctagaagctattcatcaacaagtggagagaagaagggagaagatgcttcggctggctgagctccagaaaaagattgatgaagcagccgaagagatgcgacacatcacacaagacaatgaacaagggcataagtaacaacagagagagcttcgtcaggaaatcccaagctatgatgacgtatgattttaagattttcatcatgataacattgcttttgatgatgctttccccctagctacagaattgcaggctaccccatggccacaaaccaccacaccttcccatgtatgacgggtatttgaacccgaagcagtttctc

SEQ ID NO: 12670 - DNA, 1500 bp, Zea mays
acaccaacgaccttggaggcttgaacaccatgacattattattgtatagtacaagaaataatatagctttgaaggctttgtaataatacaccactactagataatatagtagtatatctggatccgcccctgtgattagcggcttgtacatatgcagaaacccaagagagctggataatcccagctagtcagtgatgatcgatcaatgaggaaggactttgaattatttatatatgcagtcgatcggccgggggctgcaatgcaggattagtatttatgaattggaagctgtggcgagggtcataaagtagaagcaggcaattaacaatgctacgtcggaagattaaacaatcctggagacgataacgttgtttaggcgtccggaccgtaccttgtcggcttgccagtttaaactacttgtacggcagcatacgaggaagaatatgccgagatggatgccatgcgtctctggcatggaaatggaaggtgtttggttccagagcgacgcaacagctgcctagtagtatgccaggaacccagttggtgtactgatgagccgagtggctgtactgcaagtctacaacagccatccgtgggccgtggcgagtgtgtggtacactggtactacgggcgacgtgttttacctcgaggcgagtgtcggtcgtcgcgtgtagactaatgaaagtttagtgacataacatggcaagttagtgatactaagtgactccgacgtggcattcggcatccggttttattacaaaccgattttagatatttgttgtatggactgacaaagttcgaggatctgtttctctgattttctaagtttaagaataaacgtgatacaacgtgccaagttcgttgaccactagtgtattttactccatcatattccattcctcgcattcttcttttactccacctaagcactgttgtcatgtcttcctaaactatatagggcatatatctgcttgcattccagtaaacaaccattggataaagttttaacgtgttgaagtctaatggacatgatttaataatagtaccttaaccatttttatgctagatatgttgccatatataataaatcttactataaaaaacaaagatgccactactgaatgatgtgttgggctcgaggtaacgagctacaacgcaggcacgacccagatcgttcgcgggccatttgggccacccacattatacacagaaatagtacctcctcttggatccttgatgcttggtggcctcgaacaaagtacaggtccatttctagcctatcgagctcctcaggtagtaaaaccctacctacacctcgtgccgcctccgtcgccggctcgcctccccatcgacgcgcaggcagccctgcgtttgctcctcgtcggtcgggaaaggggcgcgccggcgctgcctccagcaatcaactcgccgcatccaatcacggcgcctccctcctcgattggctcctcggtggttggttgttataggcaggcgggaagg

SEQ ID NO: 12671 - DNA, 1087 bp, Zea mays
agtttattaaacttagggttagtttgaaaactccatttttccaaagaattcctattttttcaagtaaaaataaactaatgtatcttaggaaattaaaatcccgtgaaaaaagattcccaaactagcccttaaaactaattttaaaattcgctatatattttccagcactgctatcttttccacctctcctttttcttcatttttgctgcaaccatcagttcaaccttaccttgtaagaaaagattatgcctttctagcacctcctggccaccaaagaagcaaaaatcttccaggttcccacccacacggccacacccactgttctacatgctcatgcatcctcctaatgtaacctgaagctttaagaaaacaaagtgctcccggaagactccaagctgcagctaccggccttcctctcccccattccaattccgagaacaggggcggcggagtcaaccaggtgagctgcgtctttaattccccattcatatgttagcttctcctgggctctctgtactaccgtctcccctcggttcttgatttgctgcccagttcgaccccttgtccctgaatccaaggacctccgattcttcggaaccggaagctacctggaaaggaaacgaggggcaaaataaagcgcaaaagcgagcgtaaaatgctttgctaatctgctgcaaaggcgtatttggagtggtgccagaatagtagcagctctgctggcgtggagcgagctgaatctcgtgaatctgttgcctggaatgtggatgcggaccaattggtactatcttggcttgactccaaatacgtgaatctgatggctacatcttgaagcgaactgaattcttcagttacgtcgggctgaatgaatctgaaacttctactgatccgttacatgacgtagagagagggccctaggatacatttcctttctcttttttttttggttaccttttggctttatggagaagctttgagcaagccagcttttctgcgtccatcagccacagctgatttcactgcgatagttttcttcaagcagtagttttgttcctgtcaactgaccaactggtagtggtaagcaggtacg

SEQ ID NO: 12672 - DNA, 120 bp, Zea mays
cgccttttcattttcccccccgattccgatcgcttttcaccgccgcctctgttccttcgctagtcgacaggccccgcttccgctctcctcttccaccggccaccgccgcgcgccgagaag

SEQ ID NO: 12673 - DNA, 1500 bp, Zea mays
atagcactgaagctgggcaaagattttttttaatgtctgattcgcactctctaactcttcaagtcacagtctagcctgttcgcttggctttaatatgtatcgtcttttactatttttacagtgtttttatctctatggctgcatcattgttgtctcctggcaaaggctaaaaccaatgtttttcagttaaaaaagcttccaatgcatatttctgcttatgtgcattttagaccacgcatcctgtattcctgttgcgtacaaaggaacgcttatcattcaagttcatgtattagtacaggatgtttgccgtcttttcatgcatgacgcttataaatgactgctaaggccttgttcgtttccatcggattgcacccggaatcgttccwgctaatcaaagtttatataaattagagaaacaatccagtcaggaattattcggacccaccaatccgatagaaacgaacaaggcctaaaactgcatgggcttctttatctgaaactgtagttttattatcgctgtttgcatagtcaacagcatccaaacattacagataatctaccataataggtatgcaactttcttaggaaaaaatggcaggtgctctgccttgtcatttaagcagggaacggatatttacgtagagggttatcacatcacatcaaactgatgcagttctcaacaaataaaagaaaaaaaagggacagaaacggcagaccacaacatgtctgcgatctgcccatgcatcaagtggtgaaagtgagtattgtcaatcgcccgttgcgttctagagtcaggtgaagtgtcgcttcgcgttcgacattgcagagcctacaggtcttgttggtacccagccgcttttgattactccctccgtttctttttatttgtcgccgagtagtttaaatttgtactaacggacgacatatattaaggaacggagggagtatttagctgccgtgagcagcttgtgttgcagtgctaaccgtggataaaattacttttttacaccttcgttttccaaactgagttccagttgaaggtgattcagcaagtatggggggattttctgaagaatgctatcaactctagttcagtcataagggagaatgtgattcagtagagtaagagtatgctttgtttgacctctctactgaattgttctatttttgttggctggactccagtgattcattctgatcccaaaattcaggagcgacaatcttgacttcgtttgtcacaaaagaaattcaggtgtggcaatgtggactttgtcaaattcgacgctctctgccaacgaagtcaaataggactgcccgccccgcgttgcttctctatagaagctgcatgcctataaagatgtgttgcagctccttctcccatcacacaaacatttcatcgcctcctaattcctaaagcagcatcggctactagcctactactactgtctcttgctcacacagctcgtctgtgcagcacatagctagtgaacgaaaacgacc

SEQ ID NO: 12674 - DNA, 47 bp, Zea mays
ttgctggttcgttcggtttgctcgccggttggcggcggcgcgtgagg

SEQ ID NO: 12675 - DNA, 1500 bp, Zea mays
gaacgaccattttcaataataccgatgtctaacacgtacggagttttgaccaagaactggtctccaccagaaatcgaagaatgtgatctatggcaaggaaacatatgtggggtgaggtgtacgagcctttggtcgatgatgaatggccacacaacccccatttttgtcgaaaatagccatgaacgacaatttttgaccaagaaatggtctccaccaaaaatccaagaatgtgatctatggcatggaaacatatgtggggttaggtgtatgagcctttggtcgatgataaatggccacacaacccccatttttttcgaaaatagccatgaacgaccattttcaataataccgaaggctaacacctacggatttttgaccaagtaatggtctccaccagaaatccaagaatgtgatctatggcaaggaaacatatgtggggtgaggtgtacgaacctctagttgatgatcaatggccacacaacccccatttttgtcgaaaatagccatgaacgaccattttcaatgacactgaaggttaacacctacggatttttgaccaagaaattgtctccaccataaatccaagaatgtgatctatggcaaggaaacatatgtttagtgaggtgtatgagcctctggtcgaagatcaatggctacacaacccccatttttgtcgaaaatagccatgaacgaccattttcaataataccgaaggcaaacacctacggatttttgatcaagaaatggtctccaccagaaatacaagaatgtgatctacgacaaggaaacatatgtggggtgaggtgtatgagcctctggtcgacgatcaatggccacacaacccccattttgccgaaaatagccatgaatgaccattttcaataataccgaaggctaacacgtacgcgtttttaaccaagaaatggtttccaccagaaatccaagaatgtaatctatggcaaggaaacatatgtggggtgaggtttatgagcctctagtcgatgataaatggccacacaacccccatttttttatgaaaatagccatgagcgaccttgaaaatagccatgagcgaccattttcaataatactagaggctaacacctacggattttagaccaagaaatggtctgttggggtcgtgcttcggtgcgccgaaggtctcacacgaagaagcagcttcggctgaagtcgtctccaagagatggccgaaggtcccttttcatggagcttcggcgttttaaaccgacatagagatagaatgacctttttatacatataggtctgagtcaatgctgtaaactttcgcaaggggcataattgtaatttgtcacaggctgcgacctgtgcctataaatagatgaacagtacctctgtactgttcacgtgaacctgtcatttgctttcgcatcacgcttgtacttttgccttccgcaggaccgaaggtacatttgtaaatcaaagtcatttatattcattaatacaagtagagataattct

SEQ ID NO: 12676 - DNA, 1500 bp, Zea mays
atctttattatagtattatcaatgaatatgaacaatattgagttacatttataccttcaacatgatagaaggcggaaattcaagtgtgacgtgcgagtgaatacaagtcagcgtgaacagtacggtgccacttttcatctatttataggcacaggacgcaacctgtgtagaattacattcatgctcttgacatttactattgacttaagtatgacctatcgaggactagacaaccttttcccctttaagtcggtttcactttccatcgctgagccaaagcttttttacggggagctttggcactggttcatccttctgccaaaccgcactcttcatattatgtgtgttttcattccatgtccgaaggttcctgtacatatattatacttgaaaaacatgttagttgtgtttttgaggaccttcggaagatgaaggcccccaatagtgggttgaggcctggggtaagagctgcagccgatcggttttcatggaaaagactgtcagacgtgtgatcttggagaaagtttcattattaatcatctgatagtagttcagctttagtgacaagtgggtctataacattatgatcagttcaccgattatgaaccttccacttcaaattcacgcaataccgcgttcggagcatatccaacacgcgcacagtgcctgacaaatgggccccgggtccgcatgctactgagcatatgccaaagaaaccggtttgactttcccaaccccaactactaccttttttgctccattttcacacccatgcatctagtaatcctataagagagtagggtatgctgaaccgatgttgggttcaatacatcaaaaactgatcatcacctagaccctcaaccttccatgaaaccgatcatcacccagaccccaactagtagccaaggagatgacaggtccagtaggtaaccataagcacacggtctatgacaacgaggcaacatgcagattacgcgcaaacgcagagccgtcccccgatcagcctgcgaccgtcggcgtggaccaaccaccggtaccagcgccaaatatcggtggccagcagccgccccttgtattgtgttttgtgacattatgcttttgtatgtactactccctccggtttcctattagttgtcgtttaggacaacgacacggtctccaaaacataatttgaccaatgtttttttgttaaaatacaaataaactcttaatacatttatacttttataaaagtactttttatgacaaattggtgcatataaatattaggttccaaaactaaataacaaaatagttatttgtagtcaaaattttataagtttgactcgaaccttatccaaaacgacaactaataggaaaccggagggagtatttgttacacctacctaacacttgatttaattaaatcgagactagttgtccaaagcataatcaaagcaagaccgcccttgcagagcaatctcaaaaaggctcagatcaacacaacctgtaccaacagca

SEQ ID NO: 12677 - DNA, 1500 bp, Zea mays
gaatggtactagtagcgtatgcatcggaagaggccaggtgggtaaagtggaacaaccaaaatgtggaacgatagatgtgatagtagatctatgacaaagttttgttgaaatgaatctaagattcggatgactcaaaggtaaaaatctagtataaatgtgccccaggaggctctattcggttgcgtctggattgaagaggattaaattcccttctatttaattttgactagggatggatttaatccctccaatcttcttggattcagacggaactagagtgcattgaggattggagaggattaaatcttctactatttaaatttgaataggagtggatttaatcacctttaatctcttttaatctattactaaccaaataagccctaaaattttgttcgattagaggtgtattggaggattagagtggattaaatcacttctatttaaatttgaatataagaacctactgggttgcaatgggattaaaagagataaaatcatcttgactatgaatagatttagtctcctttaatacccttcaaactcatcctaaccaaataggcctaaagtagagtcaaagtggaagcagataactatgtcatgtttaccggtcaaaagaaactacgcacttatcgggccgggtgcccacgtgaaggccacaaattagcggtaggccgtaagtgacagttacttatattgtgttaataagaacatatctttatgtatcatggagaattacaattatgtcagtttcttttaatttataacgcggaaattgtttttcttgtacatccttaattagattggacaacattccttagtcagccttaccttcttaattatatttgatttgtgtatatgtttgaaatcatttactatttctctgtctaattaataatcagctacttgagtacgaccacggtgtggaattttttttttgtatgtaagaagataagtaggttgatattggtggatgcacacgtatggtgatgcgtggagcaagttggactatataccggtccaccaatactcccatgttcgctttggattggccgtggaatccgagttgaaaaatagcataagcacatgagcataaaaaaaatcgcaaatcaacttgggtgcttatttcagaaaactatatcctgcattagtgacacgaatatttcgttacgggcgacagaactgatgactcacgatccctggctgatacctgatgtagacgtccactccagtccttgacgaaaaaccacatgctttgcccacgggtatgcatgcttgatccatccagtccagccacgcacccacaactgaactcgcttttcggacattcattgcaacctcacaaacgtcccatttgtgataagcccacagatgtcaacaataccagaaacacatgtcatggtgcagctggtcgccccccaataatcccaacccctggacctataaatacacatatgtatgtcgacggagcaacatacccagcctgtttcagatccaaca

SEQ ID NO: 12678 - DNA, 434 bp, Zea mays
ggtcagttcataatgagtcggcacttttcctttgtaatgatctccatctgatgaatggaacgtggttgttgtgcttgatattgaattcctcattctgttcgacttatgtttcgcctgataaatccaatagaattaacccaactgacaattccgactgacaagccttactggtagatccggctcataactctgtttgatgaattcatttgatagatctgactaacaaatccatccaacttactccactcaattgaggtttggttcgagttacttcgtctgtcgtgatgcaccctacttattgcatgcatatacatccttgcttgtagtttcctagcgaacaaaccctaactctgcttttctctgtcgtaaacactttcctgaaattcctgcttgccctcaagtttgcgtttgattcctttcatcagcgaggtccc

SEQ ID NO: 12679 - DNA, 1500 bp, Zea mays
aagcgcgaagagggatggtgatgatgatgatgaatgtgaatcgtgtaaaccaactacggttcaaactggtgctttatatggtagagggacttaaggtatgttttgtttagttgtagatttataaaaaacatgattgtagtagttagttgcgagaaagctgctgcgagttgatggttatggaaaagctaaaatatatttggttgaaacaaatgtcacctgtaaattatataggagcatgatagcttataacataracgatagtaatctggccggaaacattagggtataaggtgataatggattgaaatattgaaatatatagattttcataagtctattctaatattgtactcgtttgattgaaattccttatttgtagcaacggatttggttcagaaagccgaataaaaacaccgttaggatgtttttttatagagaaaaggtaaaattttgcactaaaaatagcctaagcggtgtttgaatgcattagaactaatagttaattggttaaaaattattagcgaaattagctaactaacaaatagctacataactattaactaatttagccactaattattagctatagtgcattcaaacacaacctaagtctacgatatctttatcttccatgggtaaaaaaaacagtgcgtgctccttttccctccgcataaagagggaagtcacctggaccaagttttctactgccgccactttttaaatatgcgatgtttaagataaactaatcagtccaaaataaaatagtggttgaacgtttaaaacaggagggaaattacacaacattaaaatcaaccttagcacgtacggagtacccgtacccgtacttgcatggcacatgaatacaagatccagaacattcttgacttgttgtcagcctgcagcctggctggtcctgcccgtgtccgtggctgacagaacaaacaggagagaaagagagaggagacagaaacggcgaccgttacgggaccgcccggcccccccgttccgtgcgagccgcccgcaagcgttcaaaatttcaaatactgacacggccgcagcgtacggcgtcgcgaacgtgatagctacggggcgtcccgtcccgtccggccgtcacggggtcaaccctcccgccgcaggccccggctggcagcgcctcgcggagatcggctggccgacgcccggtcccgcgtgtcatcggctgtggagggtgggtggtggtgtgccggtgcgtgcgcagtgggctcttcgaaagagggtgggggcccgtaagcaccacacagcgaccccgcaccttccttccattcgactccacactccactcccagcctcccctcccctcccctcgcctttttagagagagaaaccacggctgccggcccccagcgagctagagagagaaaccaaggccaaggagcacagcaccccgtacgtccccagcaggagagggagagacagaagggtgtgcgaaggaaagaagaggcggtgggagaggagggcgac

SEQ ID NO: 12680 - DNA, 783 bp, Zea mays
ggttgggtatatatttcatactcctatttaaaagtcaaacgcttgatgtgacccgggctaaactttagcaggagcaaccaaacaccccttatttaggatacagacaatacgtatttattttctgcgttatttttattctagtgtgtctaaaatcccgtgttccaaaggaacgtcgatgtcaaatgtcaaatctttcgttttcagaggcctataaaaaataaaaggcccaggcccatgagacggccttcccgccactgagtcctcccgagtcccgacaaaacgtccagagcagcaagcagccgagcacccaacgtcccaaccgccgccggaggcccggagcgcggagcaaaaccatctccaaaaccctagttattccctagcgccgccggagcccggagcttcgacccacctcatcgcgcctcctctctttctctctctccgccggcttccttgactgcgccgcacccgactctcatttttctccctcgacggtgctcgacccccaccggctcagcggagtcagcgctctatctgtccctctgccgcgccgagagtaatttctccttgggaccgcagaccgaggacggagcgagragaagccaaaatttgagtttcgtctcttgccgacgccttcatttctttctgtgaaagctgctgtattttgagggaagctagagggtcttcgtcgacccagccaagctctgccttgtttggacggctcgggtacgcgtcggtgtcgcggcccccccggaatagtgaaccctaaacccctctccgttgctc

SEQ ID NO: 12681 - DNA, 50 bp, Zea mays
gctgctagcctgcaacgaacaaaccagcgagcgagcgggcggaggaggag

SEQ ID NO: 12682 - DNA, 79 bp, Zea mays
tgcagctaccattgctacaacacgggtacagtacaggtgaggagggagaaaacaaacgaacgaaataaagagagtacgc

SEQ ID NO: 12683 - DNA, 94 bp, Zea mays
acgagtctcatctctcggagcctcggcattgctggtttcttttgtgtctagtagtagtagatcgcttggcggcatccctggtgcctagtgagac

SEQ ID NO: 12684 - DNA, 611 bp, Zea mays
ttacaaaaaataaaaataaattgtggagccatctctccgtaaaagactcgtaaactaagtagtaacagacactttataatataaaatttaatttaaaaataaataaaaataaagttcgatccttattcaatttaatttaatctgatataattcttaaatcttataatgtaaagtttagagttcataatcacatcagcttaaaccccgccggccgccgcagccgcaagtccgcaacaacaaaacgatcaaaccgcctttatcgcccgccccagcaggcacacccatcggccatcgccagcatctggcttgattggatttacagatcgccagctgttgatcccatctgaccccagggcccgctagtcagccccaccgccacgtgacctattaaatgctcatccacacacacaagcggcccctccggtggcttctcattcattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgact

SEQ ID NO: 12685 - DNA, 79 bp, Zea mays
ggtcaaactcactagctagtagtacaagcagcacagcacgaaaggctgcttcctttttcacaaccaatggaaatatgaa

SEQ ID NO: 12686 - DNA, 507 bp, Zea mays
ggtagttcaggggtggcagtttctattgtacctttacctgttaataacagaaacaatgccccaaacccaatcagtgaactacttgttggaatctacatatgtatgttatttctaagatttggaccctagaatcgaccaccttacctagccagcccagtctccaaccagattacatctgtgtatgaatctgtaccctgatcaaacgtggcagcctatatggttgtgggaaagaaaaagaaaaaaaaagggtaaacaggagcattttctcaaccttcctagcgtctattgttactgtccaagtcttaccgaatccgtggttatgttctgctcttgaactttctatgtgacttgaggtcgactacaatgacggtaatgttgtccttgctccccttctggagggccagcttcgacaaatattcagcagctgcttgagctgcttcatctgccgaatcaccgcttctttgggctgacgctgagtcgtcgccgttcttcttgtgccacagcagt

SEQ ID NO: 12687 - DNA, 211 bp, Zea mays
acgggatcagtcggttcgtgtcatggtgatatgaaaaagaaccgtgtgctctgctcgactcaactagcttttctccattcctcaaggctgcaggggtcggaggcagtgatgggatcagtcagtactttactgacactgcttggtgcaccatgcatgagaactttgatgtctcatgtagtagtcatgtctgcttcgccttgtaaataattct

SEQ ID NO: 12688 - DNA, 1500 bp, Zea mays
tacatatatctgaaaccgttaccaaactatccaataaaattactactccctccgttcctatcgaaaatttatcccaagtcaaagttttaaaactttgaccaataatatttataaaaaataaacatttttaatttaaagaaatcatatattgtggtatatgttttaataataaatataatagttttattttatttagtaaatattttaaatattttattgttaatagtcaaagtttcaaaacattgatttaagacaagtctttgtgacctttgactctctccaacaatgtcttatatatccatcctctatatcttgtcttttacattctactctaaaaaatttcatcatctatatcttcttcatctccaacagcgtcctctatatctcgtcctttatacataaatacaaatattggagacataatttacttttaattttttacatatgcatttgtcatattattaaatgtattatatatattttagttttattaaatctattgtttaaagtatgaaaatggatagaggggaaaagagaaaaactctatatgtagtctataaaggattcaacaatgtcctctgaatttagaggatcctttagagtatgctgttggatacgtagaagacgacttcattctctaaacttaggttacagaactctttagatatacttgtaggagttagtcttaaaatagggaacgtagagagtatataataaaccccaaatctaaattaatgaatttcatattcagatgcgcatgggctcttccgatcgtggacttgttacttgttactccttccggttttctaataattgtcgtttaggacaataatacaatctctaaaatataactttgactgatgttttttaaaaatataaataaattcttaatacatatacttttataaaaatacttgttaagataaatccacccaaataaacattagaattcaaaactaaatactaaaatagttatttgtagttaaaattttataaatttaacttaaattttatctaaaacaacaactaatagtaaataccagtccatacagttcgtagacttgagacgcacgcactcagttgtcaggatagtggtcgcggaatttatccagccgtactcagcctgtcatcgccattgaatgggtcgctatttactgcaagatcacgatcggacggctgcaagcgcccccaatccttcaatggttgtcaaccagctcttgagtattcaagttgattttaaatggttttgattaattcttataaaataaggctgaaaaactgattatttggtaacttctgctggccagaaaaaaaaaaccgaaacaaacagtcactcatcctctttctgtctttcacccccgcgttcacgccggcccaaaccccaaatcgcacgcgtcatcccaatcccaacccaattacgacacgcctgccgccgccacgccgcccgaaatccggaggggaagctcctcgacgacgtagcggccagtggcagctcggacg

SEQ ID NO: 12689 - DNA, 92 bp, Zea mays
gtgcctgatattacaagacaggaaacaaatatagaggaaaagatggatctagagtagaagggaaatctttaagccaagagcaagcattgctc

SEQ ID NO: 12690 - DNA, 83 bp, Zea mays
ggtcagtctattaccattgtttttgtgttattattgattttctaatgctatatataagatgacatgcacacatatttgttgtc

SEQ ID NO: 12691 - DNA, 1500 bp, Zea mays
aagctatcccaatcggcacatgggacatattctagaaactccaaattagtgtaaaataaatacagccagtaggcccagtacagtatgctgctaacaatgttctgtactgtacaaccagtacagtacttatagaccagaattcgtagagcagtaccaaaagcagcttttagatgcacaataaaatctatcatgtctaaaacgacttctttcctttcctttctttcgcaaaaaaaaaatgttaaaacaaatgcaggtaacaattttcttttcactgctattcttttgtggtgatatatctcaaagacctctttccttgttctacaaagaaataagcctattttctttttcttggatgaaataaatgtggtaacctcaccagtcctttctgtgattccgaggagtgcacgttagcctaggaactcacaagtcagtgctcttctgttctcgaatagcaatagcaatggaggacgacgatctggcacaggagacggcgattgccatttccgtcgatttcttggcgacgaagaccggagcagacacacacagctgagcaacccccacccacgttgccaagaacgtttgcttgcttgcttcgaaaggcagggatcgaagcatttctcttcatcagaccaccgaacacgagcaactgcgaccatcaagattcatgaggcgcccgcacactgcaaggccaaggaaaatcacctaagcctaccatacttgtttggggcaaaaaaaatatatagcaacggtgcatccgcattcattcagttaaaacctcagagcaaacatccgccaagcaaactccgatacctacaccaccctttttcgcctatatccttttactttgtgcacatgtcaatctacagcacacacatcaatgcaatgcaatgcaaatgcacggcccgaaccagtcacccccaacaaaccaggtttcatccaggggccgtgccttccagccggcagaaaaccgcgcctccaccactccgctcacttcacgttaggcttcggcgagtagcggaacggagacgcgcggggcccgtcagagaggctcctcacgggcggcggctgcccatgccgcccaaacgggctctgagtcttgaagccgccgttcatgctgctcctcccgttcatgctgctcgagtgcgccatccgctcggcgtgcatcgtctggaagaagtaggaggcgctcgccatgtccttgaggttctgcagcggcctgaggacctccaccacctggctcatcaggggccgcgccttggggtcccggctgaggcaggcgcgcgctagctgcgccgccttctgcgcgcccttcacagagaagttgccctccagccgagggtcaaccagcttgtagaaccgctgcctctcccctaggaggggccgtgcccattccaccaggttgtgctccccgttgggccgattcttgtccattgacctgcgccccgacatcatctcaagaagcacgaccccgaagctgtagacatcgctctttgatgtcag

SEQ ID NO: 12692 - DNA, 141 bp, Zea mays
gtcttgcattaaagacccagacccagcaatagggagaagaggaacccaggagctgcccttcctcgtcttcctcgctcgtcaagtcatcagcatctcagcacccaaagtcgacaaaattgaaggacacctagccggcaaaac

SEQ ID NO: 12693 - DNA, 1003 bp, Zea mays
caccactagacaaaaggatactatttcttatccttttaaaatactcaaacatgaatgtagttgtccagtagcactagaaatgatgaaccgaatgctctatcacaaaatagagcaattctagatgcaaagcaaatcatttttctcttcaacttgactagatttatataaaatacaccaacattatgtctcaaaaatatttaatataaaggtataatttataattaatttaactatgaccgcaatgtatttttgtaatttctttagttttaattgaatttaaaattacttggttcaacaaaagctgcagtattttttacaagagagtagtgccctttttttctgccgcaaagtatttgcgatttcgacatcatcgctgcgcttctggcacgcctgtccgcgtaacgccgttaccgtcggctcacgctgaccacgtcgcaacacgaaacacatgcttgcattccagttccagattccagacacgcgggcccacttcccgcaccaacgcgacgccaccgagcggccacgcttctcctcagtctcccaaacctacccccacggccccacggaccgggaccctcacccccagtcccccacacggccacaccactgcgccgggtccacgcagcagaacccccgcccgccccgcctcccagttgcagcgaagcctcctctggctctacggcgcagtgggtaggtggtttgaccgtgccgggccaaccccgccggccaccgcccggccacctatttaagcccccgcacctcccacgcctcgccggcagcagcgttgcatcagctgttgtaattacgtggtacaggacagtgcccatttgccgttgccgcgtccagcattcattcattcattgccctggccttcttccttcgggccttcccgtgccgtcgcccaacgcctcacctaccaccaccgcccgccaccaaaccaaaccaacccctcggtcgccgacgccgagtgacgtaaacgatggactcggcgacgtcgggggcg

SEQ ID NO: 12694 - DNA, 1500 bp, Zea mays
tataagtaagtaagccagctatcggaatacaagaagttatgccgtaagcttacttatcgtttacatagttttatcaagatagaatagaagaactcaagtccagtaagaagaataaaagctgtgattaagcttctcggctctctgtcttttagtaagcagacgagtaagcaaataaggtttcaagacaagcattagtagtaggggtattaactcttgtattaagcagtagtttcccttgttttagccactaagttatcagaactgaaagtagtatttaagcttgacttggcgtctcgatagtattaatagctgtggcaagctttcaagtacgaagtgaagaatgtaggtcagctatcaggtttccgttctacttagaagtttgtatgccctttagaggaatccaaggagaataccagaattcaagccggataccagattgaaagtggagttgccgctgaatacgtatcattctatttatcaggtataagctttccagtcggacatcagaatgcaagtcagcgaatctgcttgtagtttaagtagtattagcaacatagaaaggaagtgccgaatgaagatcgtaagcagcgattcctgtttgagtaagttcattacagaatcgaagtcaggtcagtcagccaatgcctacttcgatcaagcgttagatggggttggtggtgttgatgtttcaattttttgtttttgtcatgagggttgaaacccgtaaatagtttccttttttctggggagtatagttctacaaggttccattcatcgacctttctaaatcctgactagatcagtagtttgcaacagtatatctgactttctggtccagttggtcctattattgctgcatttccgaattctattgacacgcatcctccgaagactttactatttgccaagtactttattgagtatttctctataggagttggaatctctctcaatgcgggagaggaatacaaactacccaaccttaggcccacctataggaatggaaactctaagaggaattcaatccaagctactcactcgatacagaaatattgttatgatacagggattattctgaactacgactctctcccatactactcctctcttctcccatgtgggttcactcctctattaaaggttaaagctactctgagatcgtataaaggaagcgtatcagagccgggacaccacactggagtgaatctatctcgaaatctatctgattggaaaggggattcccaaagaagcctaaaaaaggatgggcttagaggcatgagcaattgcagctttgaactctctttctcagcaagaagaatacaagtcataagtaaggttgcaactcataaatcagtttgcttgtagtaagcagacgagtaagcaaataaggtttgacagccgctctgtcgtttctacagttttatttttagtttgcagtttgaccttctctagttatagttctttctgcaaagcctctttttcgtataaatactattataa

SEQ ID NO: 12695 - DNA, 839 bp, Zea mays
aaaggcgggccggaggacgcggagctgcgcccaggccgcaggtctggcgccggcatcatcgagtgtcttttgaataagcgtgtagataagcccgtgaatgtggaaacgaggatgagatgatgttcttgtaacgctgctgtttgtcaagcatggacgaatgctctcatatcatcatatggtgtcaaagtgacaaagtctctcaatcgatgtcttgatgtcattatttttatctccctgaatgtttttacatgttttcctctattcattgtatcctttatgcatacacgaagggagaactttcggctacctgtttggttctaccataatccatatagattttcatattttctatagattgagggggattgatgagttttaaactctaagttaaaatctctccgatcccaatcaaaccctaatggagaccttttaataggcgcgacggcggtggttgagaggaaacagaataggcgatatgaggcaggcaggatgtggagaccgggagtgcctgcatggcgaaccggaggagggcgcggccagcagatgatcggagcaagacccacatgtcgttgtggacgattcccgtttcgtctttttaggagtagagagtagaatagaatgaaattgttgcaaaataaaaggcctactaggtgccaagtgccaaattgggccaaattttcccaggccgacgaaaacagctgggcccatcagaaaagccacaccccactcaaaaccaactaaaacccaaactgaaaaccctgtcctcgtcgtcgagccagcccccccaaaccctaggctgccgccaacccgactggctcccccctcactcttctcccgcc

SEQ ID NO: 12696 - DNA, 1500 bp, Zea mays
agtttgttttgttaagctattttatacaggatcacctattcacccctctaggtgctctcacatccgccggcgtgggaagaagttatttggtaggggagaggacattgatggcgtggactttatccagacggagatagcggagggcggctggcacaacggctgtggaagctgttggctgaggcatggtgcggagggcggggtgagggggcagtgggcacgacgtgcgcctggcgatggtgagggcacggatggcacgagagacattgaggatggggatacaacggaaaccgcggcgccgcgcgtcggtgtgggccgtggggagcatcgcgcgcaggggcgaaggcgggacacggttccactcgtggtctacattacagtcttaatggtagtagaatctattttatatgcaaggtcgagagggcaaagctcatagaaggcctcactctattctatccatatctacctggtttacacacatgtaacacacatggtattttttactgtgtcctaggctgctcacctttttcacctctcgcctctgtcacgtcacatcataatcaggctatcagaaaatctgaccactaattggaatcttctgccacacctgctctttaggaaggaaaggaacacttcttcatcaatcggcccaaagaaatggtattctatgtccatttccctggtcgtgttattccttttcctgtgatagaaatggtgatccgactccattgccgaatgcaagttttttgccgggcaatgatgagatgggtaggtcacacgcagataaaaaagggatgtaagtaacacagcaggacaaacaatggcatgcatgacgtttgttttggcctgtgactgactttgtgcgatggcagagcttgtcctatgctgtgtcttgcatgcgtacatgaccgaccgcgaccacacgccgcggcgcagaggaacaaacgtgaccaagttcgagccggrgtagcgagtcgctttgtcatctcgccgtgctggtaaaaggcgccgaagatgagatacaacggaaatcgtggcgccgtgcgtcggtgtgggattgtgggagcatcacgcgaggaagctagggacacggttccacctgtggtctacagtgcagtagtagagaagagaacatggtgctccctttctataaaaaagaactaaaaaaagatagcttactttctttatgtcagacgttctattctgttttgatttttttttcaaattttctgtatggaaaccttttgttacaaacgaatgtcatgccaaatatcgaaagctctcgtacgccttcgtctaatcgtcttctctactgtccctgttttgttcctcctcgtcgcttggcgcttccagagaaaaacccgaaagacgtctcgtgtcgcctccactaggcacgtcctggaaccttgcggggccggtattggaaagcaggcaagcacaacagcgatcccacaaaccacagctcggctcctcttcgccgtcgcaaccgatttatatatggcg

SEQ ID NO: 12697 - DNA, 1285 bp, Zea mays
agagggagctgaataggggtattgttgaagaaaaggagaaatatggggatgaatcttttaacaggaggtattaaaatatgaataaaaggcgcgaattggagatttaggaggaagaaccgttggagtcaactttatggcctggtcttatagttgacacttggatatgtacgatttcttgatagtagatgctagaaatttattttattattaaaacaacttggaataaacaaggcatgcagtaagattagagacaaagtaaccctaatatggaaatacattctataaaacaagttagcctcaactatcaaaatcaagagtgtcctctcacaagaagtgcctctgaaggcaaaaaccttataaggccgtctacaacagtatatctaaagtttacccaaaaacactatttttgtactgttgtgcgctgtagactgtattgttcgcatagtagagtctgaatatgggtatgagtaagctgctgaagatagcctaaggggctctacatctagtcaacaactaatatgcaatcagaccttatgtgtaagtgtgcaagcaaacatcttggtccgttagatcatgattcaactgtagatataatcgtggtttattaggagttttctataaaactacacgagccagtgatagaagatttaagtatcaaatgtgatacatggttggatcatgatctaacggatcaagagtctcacgtggtcgcttgtacgtaaggtctaattacatattagttgttgcactacatctattagtcaaactggcgaagctgtgagctaaaagagtattgattatgtttgtattttttccaattattttctaattgaaagaaacacattgtataagcaaaaccttatatatacttgatattctcgtgtttttgtattggtaaagccacatgttaatattgttgaattccgttgcaggatacagaatgccataaatgctggtatatccaggaaaaaatcatacataggaacctggatgatcctcgagaggctacgtgagtacgtgactcactctgagtctcgatgaccttcgtctccactctccagcacgcagtcgcagttgtcgtctggggtggtggtggtggtgggccgaggtggagtcgtcggatctcacacacgcaactctctcaagactcaagagaggaaaggttgctttccggccggaaagggaggcgagcgcgagacccctgtgatcccaattaagcgcccagccgcgacggccccaaaacggcaaacctccccagcccgcccgcccgcgccgcccgaccgcg

SEQ ID NO: 12698 - DNA, 442 bp, Zea mays
tcttctcattcagcgatcttcaaattcaatatgttgtccgtcggattggcgctctagtctggtgggtttgctttcagatttgccgagtatcaatccgggtctccattcggtggtggctgaagcttgatttctccatgtcgctccgtgcagcttcatgaatccatgttctcaagtgtatttgatcatgattctataaacaaccatcttatattactaatctgtaggagtttttttacatgttggtggtccaagctgaaaaaaataatttaggacaaagctagattgtcttttacatttgtgattggaaggagtaggctttttcattatccagtggcagttatagacagttgttgcgctcgtgcagcttcaaatattttgggatgttgccatgttaaggtattagccttttgttgtttcagtatactagcttcctaaaggatcg

SEQ ID NO: 12699 - DNA, 97 bp, Zea mays
gtcagataaccaaacaccccaaactgcctgttcaccattttcgccccaaatctgccgaggggattagccgatcgaagcgtcatcggcggctgcgaca

SEQ ID NO: 12700 - DNA, 604 bp, Zea mays
ccttaatctatgtctttctatactgcatatgataatctatttaaatatgattatgctaatgcaggtattagttttatttgtacatgatccatgctagatgtcaaattgtttttcctgttgttaaaatggattcaatattagcttgcatataagagttagcaacaggcatgcatgtccttaaataattacatgcacatagcgttactactactgccacatgcatggcattactactcctgcgcagcttgatgcgtatccaaatcattcagcagatctgcgtgcagcgcgaaccattattataatttggttttccggccatctgcatgctgcccagccttttggccccttccgtttacgtgccgccatcaatggcagacgctcctctggccggcctgcgtgcatgcactctgcagtctgcactgccaccgccaatgcatgaaccccatgaccgcgacaaaacactcgtccatataaatgtgcacgctgcatcaccgcatctctgggctgcaccaccagaccgcgcgcctaaaagctatatatggcctgaccacctcatctggccctcttgggatgtaggagagtctcctgtcgtcgacgacattgc

SEQ ID NO: 12701 - DNA, 435 bp, Zea mays
atttccttttttggtttgcgaaattagttattttgctggcaatgcagagtagcttgattatttggtcttgcgcgaagagaacattgtttttgtgaaccctatacatttcattgtttcaaggtaatgcaagtttctgcaattacgattgcccagatcttgttcttgtttaaacgtaattctatttattgtacttcaaatctagaaactgttgctaaacctccaacatagctgtaatctcggacaccatttactttccatgctttaccagcagacacctagccagaacctggtaccatggtgaaatgattctgttctgatcctgcagtgacgttttgatcctgcagtgacggtctgcatctgacacaggaaggaaacgcagttgtccacaaggaggttgtcgaagcattgagaaatgctggtttcaaagctgaacag

SEQ ID NO: 12702 - DNA, 299 bp, Zea mays
agcttgccgcgagcccgcgacgacagaccttctttcgtcccgtcctttcccctgcgcgccgcgagtgaattccggaatccccaatctatccgacgccacacgaaacgaaacacaagagaagagaatagagagaaggtcggagggctagacccggtcccccaattccaattcgcccctctcgcggccggcctcgcgagacgccgattcggatcccatctcctgctcagagcctcgattcgaccggcgggggcgacgattcgaccgggtcggtagccaggcagaggcagcggaaggagagg

SEQ ID NO: 12703 - DNA, 248 bp, Zea mays
aattgctgccataactgttctctcattttcttcgctgtcttcgcctgctgccccaacttgcttggatcaaaaggctttgtgctatacttttcgaagtaaggttatgtttgccttgttgattatttcttcttgttgcagtatgtacgacctggcgctcctggtgcttcagtaggtggggtacctggtggtcctggtcaattccgccctcctgggcctttaggccctttctctggtcgtggcagaggtga

SEQ ID NO: 12704 - DNA, 65 bp, Zea mays
cacctccacccctggagttcaggacaagattctttttatgatcaacaataatatccatctcaaat

SEQ ID NO: 12705 - DNA, 102 bp, Zea mays
catgcatcatgcgtctgcatctgcatgcgtccacatggtggaagctaatccggtcgacaccttgtctcatcaaacatctgtttgcttcacacagcaggggct

SEQ ID NO: 12706 - DNA, 260 bp, Zea mays
accgtgccgatgggagagacgagacaggcatggggagtgatgggtgcacagctagcgccacacacttcacatgcatgaagcttacttttgttctccctcctcggctcctccttcctgatgctgttgttcgatgaacctcttgaatagtgcttgccatcatcgacccatgggctagctagctaggttttgtagattgttgtcagcgagtctgcttattgtgtgctaggtggcctggccgctgaaaagagccacccaaaaaa

SEQ ID NO: 12707 - DNA, 443 bp, Zea mays
gttggtacttgcatccattgggatggtactgggccagtctttaatcagctcaacattgatgtcattatgttactcctttaaaaaaaaaaattatgtcaggtgaatcaagacaaagaaacagaataaaaattcattcatttatgtcaaaaataaatttggcaggtttcaataatgtcacatggaaactgtgttaaaaatatgtttttgaataycccttcgataccaaaaaattatgtgactggaggtgcattcagataagattaaatatatgcgagaacacaatgagttacaagcattcttctctgcttggatcctacgttgagaaactgttagttttgttatcatgatgcctttgtgatctacatttttcttttccttcttcccgtgttgctgtatattctgacctcttccatttatcttgggacagcctcctgggtagaatc

SEQ ID NO: 12708 - DNA, 196 bp, Zea mays
cgtgcgctgcccgggcagtctggtggggcacttggataacacgctgcagcgggttattataaacagggacaggtccgcctcctcgccgtctcgtctgaccgtacgtctttggtgatgaagcatcgatccgggagaaggttcagcattagctctagctagagctagatagccggaggaggagctagtaggaagaggc

SEQ ID NO: 12709 - DNA, 468 bp, Zea mays
tgtcgccgcactccgcttgccgccgcccgccgcagctccctccggccgcgcgcgcctcgtgggggccgccgcgcaccgctgctcccccaggtgcgcgacgcaacaggcatggcctgcagcagcagcaacagtatttaaataaattaaataaatattttttccaagatcattatcgaacaagcaatcgcctcactggtcaacctgactgaataggtgaggtgaggtgaggtgaggtcagtggtggattgagaagggaggctatcggattcggttgcttctcttctcctcttcctgtacttcctcctcgtgttccagtcttgatcggaagtgtattggttctcgcttaaagcgtgtctgtcctgtgcctgtgcctgtgcctgcagggaggcgtttgggtggtggtgctcccagctgctgctgacgcggagcggccggacgaggacgacggcggcggcggcgtacccgaag

SEQ ID NO: 12710 - DNA, 1500 bp, Zea mays
gtgacaacataattgatagaatatgtattttaaagtctaaattcatgactatgatgcactaggtgacactccactggacagtcaactctagacagggctagacatgtaacgatctcagaaagaaggttggatattttctttttaattgaactgttgttttacctttttccttgcttgcttttgcttttgcagagctgatgaaagggaaatgtgcccttgggccatttctaagtattttggtgattgagtgccaacacaagtgcttaaatgtgaattcatgcttatggatggacaaagtgcaaaacaagagcaaaggtatgtttctaagtcttagtacattggttttgtgtactaatatacttgtctaagtgttagaaacagaaagaaaaagaaaagagaagagttggctgtgtacagccaaaaggctgtttcggtctggggcaccggactgtccggtggtgcaccggacagtgtccggtgcgccaggctgcctcgggcgaagtggccgctctcgggaattcgccgacggcgtacggctaaaattcaccggactgtccggtgtgcaccggactgtccggtgagccaacggtcggccaggccaacggtcggccgcggaatccgcgcgcgacacgtggccgagccaacggtcggaagggggcaccggactgtccggtgtgcaccggaaatgtccggtgtgccaacggctccctgatctgcaacggtcgactgcgccatttttggaaggaaatcgggcaccggacagtgtccggtgtgcaccggactgtccggtgcgcccgatgacagaaggcaagaatggccttccagatttgctctcaacggctcctagctgccttggggctataaaagggacccctaggcgcatggagaagaacaccaagcaaccttagagcattcttgatcatccacactcagtctttgcgcatttgtttgtcattctcagtgattcgagctccgttctagtgagaactttgagatagtcttttgagcttgattcttggccgtgtgtgtgcgcattttgctgtggatttgtgtgtgttgcttctctcccttactctgtgcttctttgtgaacttcaagtgtaagggcgagagactccaagttgtggagattcctcgcaaacgcgataagaaaagaaaagcataacactgtggtattcaagttgatcattggatcacttgagaggagttgagtgcaactctcgtccgttgggacgccacaacgtggagtaggcaagttttgtacttggccgaaccacgggataaaccactgtgtcttccctgtgttgaactccttgtggttatcgtattgtgcaaaatcttctctttagccacttggcattaactgtgctaacgcttaatcaaagttttgtggcttaagtttttaagtgctacaagatcacctattcacccccccccctctaggtgctctcaattggtatcaaaggcgttctcttcacaaagggactaaccgcccgaagag

SEQ ID NO: 12711 - DNA, 503 bp, Zea mays
tgtgcagtaaaatattatacacaaaagatataagtatatcactttctataatagaaaattgcagagacaatactttttctagaaaagaaaaacttttggttagtcttctcgtttgttggattagaatctagtgaatgttcactggttagtggaattcactaggatcagatgtgaaaagtgatcttttattaaaaataacttctgaaacgaagaatacgttagagattggtgcccacgcacgcgaaggaacaggcatgccaagcatgtgaccgtagcgacaaagctagcgcactgcgctgcgcaccagcggaaaaggccagacccaaagaaaacggagcctacggaatcggacgcacctacccgtcaccctctctcgttcattttgcgccatcttcctcgcctcctccacaagtccacctcccgactctaccaaaatcccaaaccctagacctccaggctcagatccctccccccaccttcaccccttcagagacgaacgcaac

SEQ ID NO: 12712 - DNA, 1500 bp, Zea mays
cctgctcgcaacaagctcttcagcgcgcttgacatcttccgttgaaggctaatggtacagtaaggatgttttcgctctatacataattatatgcttatctcccgcgtatatgaagcgcatttgctcttataggttcactccatcggatcaactatgttcttttgttctttctctgcaagttcatggataagaggagaaaccgctgtcacctcccctctttcccttgtccggtccggttcctcatgtgcccccattcctaacccaatcacccttcagttcagtcaagtcttcataggtgtgatttgtgaaatccatctgagaagtccatgtccatctgaaaactctatgagctgttccggaagctgtttcagtcagctgttgtcacaatgtactatgtgtgcccccacttctttccaaactggaacaggagagcagcccaggaaaatggaattaaaatgcaaagtagggcccccccacacggccacaccaatgggcatgcatcgatctagaattttcttggaaggcacttggaggcggacaggagaggaaaacaaagcttgactggttgacttgatcatttatatgccgttgagccaaatttgaggtcaaaacagaggcatacataactaggtttctcgggttcaagaagacaattttacactaaaaaaagccgaaatctttgacaactttctcttgagaaaacaggtcctatctgcgacatgggatatctatctagtgtcaaggcattgtttgtttctccatgtgcgtcgtagcacagctgcaaacagaactacccgtctggttgtttagttagttagcttcacgctggaatttatcccagaagcatctaagtatggcgtgacatttgcgagtttaacttaatcaggacagcgagttttaagtattattctttattttgttggcaaaaggaagcggtgcagttgaaatccgctggataatgctttcgaagagggttctctataatgcgaaggcttggatgctgatatctctgttgtagtttatgggtttgtgagatgactcctttcttccctactaagttcatggcctttctgaaagtctggattcttatggttgcaaagttctagtatgtggattgccttctttccacgtctgagcagtttccttcttcctttttttttcgctaggcactgagcagtttcttagggtttaagcgattgccttctttcctgacctacaagcccaggcaacaacgaagccgttacccaaacgtctccttctgttcatccgagtgccaatctgctgccttctcattgaccactcgaccccttcccttcatacgtggcttcttcttcttttttgcctcgagctaccacttggtgacgatacctgtcgcgtctaaacacggtccaattagaatcgattttctttcactctgcttccttggctgttgcctcaccctataattacgtgtcgcacaggtctcgatcttcccggccccacacacaacaaagcggggcg

SEQ ID NO: 12713 - DNA, 341 bp, Zea mays
ataaaatcatcatttttcatttaaaactagggcacgaacgccaaaaggtccagagtgaaaaaacatgacctagaatccggaccggtacgtcctctgcgccgcgcctcctcggctcctcccatccgtcgccagcgaccagcgccgcccgactccgccccacgtcgcgtgtagctcaagaccaagcacgtcttgcaccgcctagctcacctctacggccgccgaacctgcctccgccgttgccgactccaagctccactcgcctgaggtcccctcgtccgaggtgctcgactggacttcctccccccgaggtcccctcctatccatcgccgctcctccccgac

SEQ ID NO: 12714 - DNA, 1500 bp, Zea mays
cgggtcgttgtacagctagatgtaatccggtccgtttggttttgatccaacggccaaggtctctgtgtaccccttcgctgtgacgatttagcatatgagtccctcggattaatacaaatgaacctgcaatcctagcgacgggggatctgagtcttaggaaccacgccaactgcaggagagcgggccacaccgtcaggtgtggaccgaggcgcactagtgggtggtggcatgatagtaattattattatatgtgcatgatgcactgagatagtaattattattatatgtgcatgatgcattgagatatcagtgtgtaacaaatcacagtatatcttatttcttcctatctaaattgccattattaaaccaaatttrtgaacatgaagcacaaagttgagttacagcttttgctaatttgctctatattagctcattgctgatcttccactacgataactactaattgagccatattcatcacttatttaatatataacaagaatgttggagctaaaaccgcatcataatgggtcttcgacctacaaattgcatgttgtcataaaattattataagtgcatgatgcactgagatatcggtgcgtaacaaatcacaccagtatcttatctcttttatctgaattgccattattaaaccaaatttataaacaagaagcacaaagtcaagctacaacttttgctctatatcagttcattggtgaccttccactacgaccatttgctacttcatgttttttttcttaaatgaggtaccaacaaaaacatctttatagttggttttattgtaaaggtttagaacatatttgaatagaaaacgtagcaacgtacgtgcacctaactataataggtagtacagaaaagatatctctaactctactacctattaaggaactattgtagaccacgggcactaccatgccccccgttcgcccggcgtcagctctgcgatgcccgagatacgcgccctcctgccagcgcaacctccgaagtccaggcctcgccccacgttcccctgtcacgcctccctttttgcgcacacgcccaccagcttctcgtcaaccaggtgcgttcactgggaagcatataataatgatatttatcattatatatatatatatatattttatactaattttttaagtatcatgataacgcacgggcacacacataattctctcttagcgttgctctaagattaacttaacagggagcgttccaaaaagcgacccacaaccttgcggagtaggcccgtttagcctacctatgcagcccaacttatgttgtcgtcacgttcatctcgtcccataaagagctgtacacctaccggcctaggaggcccatatgctcatcatcataaacaccaggcgccgtcaagaaaaaaaaaacagaggaaagaaaaaaccgtcagagcgacgttagtcggctcagctgtagtgtagttgcaggtgttcgccggcacacgcgcgtggccgcgaaccctag

SEQ ID NO: 12715 - DNA, 216 bp, Zea mays
cgtccctatccccttgcgccggcgtgtgtcgcgcagagagcggagcttatccatcatattaccaggacatgatgatttaccagtcgcactctcaccaaccgctcttgttcgctaccagatccacagcgcgcacttgtgcctatttatttattgtggaggcgtgggtcggcaagggactcggatcagccgcagttgatctggaggcgcgggccggcc

SEQ ID NO: 12716 - DNA, 644 bp, Zea mays
acttattcctcgtggatatagtaattattagcttataataaattgtgtggcgatggattaactctttctattctacaaactaagggggtgtttggtttatagggactaaactttagtcccttcactttattctattttagtttataaattgttaaataaggaaactaaaatagagttttagtttctatatttagtaatttagggactaaaatagaataaaatggagggactaaaaattagtccctagaaaccaaacaccctctaaattaaaagaagtggggagtgacgaaaatgaatcacctcattttttcaaaccaaatttatcctatatgaacctactaaatctctgaaaagactaatattttgaaatagacggagtaatttctattggtccttaagtagtgaagtgaaattttggattgagaaacagctcgtgaagtccgttgtcttggaacccaacacagcttaaattgatgtgacaatgttggaaagattgctatcaagcctgtagtctagagacccgacacggctcgaactgtcgcgtcgccgcgtcggtctagagaacgcgaagcgcctcgccgacgccgaccgccgctccccaccaacagttcaacaccaagccggtccacccttgcaactgcgcc

SEQ ID NO: 12717 - DNA, 247 bp, Zea mays
cttcagtacccatgttgagattggtggacatgaacgcaccccgacatctttagaacaatgagtggagagtcatggaaggaagcgtaagaaaattcagattgctggggttcttgaggaatatttggattacaaaaggcaacataatgataagttgcttgatgtggtaaatcagattgatcagcaagatgagggatgtaacaagaaggaagaatattgtattgggaagtgtgttcgtgtgttagagtcg

SEQ ID NO: 12718 - DNA, 1500 bp, Zea mays
ccatgagctaacaagcatgacaagcttgactcacctagggtgtcacaagaaacactcaaatgggtcactccatctaaccatgagttgctcttaatgatctccagtgggaaagtgagagaacctagagggggtgaataggttatcctacaaaaacttaactaaaaccaacaaacttggtccataaatggggttagtgaaatctaaaaccaaattcaattaagaatagaaggggtaatttcttcacttaattgctctcacaagatgtgtattgaaactagagaaataatgaaagtgaagtggagagcgcggaagaagaaaatcacaatgaaactaagtagacaatgagacacggtgatttatcccgtggttcggccgagggcctacctctatgttgtggcgtcccaatagatgagggttgcactcaacccctctcaagtgatccagagatcaaacttgagtaccacagttgtcttccttatagtatgttcccatttgtgaggactcttcacaatttagatcaaaatcgcaagctaccataacattatgggataaagacccttttctatttctgtatggagcgaccttgtcttctgaaatagtgataggaatataagtaccatctatagcaccaatgcaattttgcatgttaggaaagagagataaagcaattagagacctaaattcctaagaaggaattataaattcttgagttttatacctacatagaaagcatgaaactagagtcggttacaattttaacatgagtacagatctacttgtcaagactgaaattatatcgagcgaattgcaaacctaattcgtttatcttttggtgactatacaccaaggttttaccggcaataatcggcggtaaaccgcccagttccccaaaaccacgcgatccccgggaacagttctccctgattttttaaatttcgttctaaattcaaaaagtggaaaaaaaagataaacacagaaaaacatacaataaaggtctaaatgtttttatggtatatctcatatttatttttaaattagttgcattttagttaaaaacaatgaaaattaccggtttctcgtcgagaaatcttcgaaaaccgttttgtttagatttgaaagcacggatcggtcaaaaaattgaaaaacccacgaaaaccagtttctcgatgaaatttggcggtttcccaggtggtttaccagtttaatgtcgattttttgaatttgaaatatcaaaccgatcccggtttttagaggttttgaactctaaacggtacggtgaaccctggtgtacaaactactcaccatgaattttcggcccaaaataaaccattccttttttatctgcaaaatgcaaggtctagtctagtacacactcgacttgcaatatacaacacgcttgtggcctgaagaacggaagaactcggactcgagcaccccgaagcgagccaccgccgatctgctcctcctgagtcctgaccctcctccgtgcgctgcgcaggc

SEQ ID NO: 12719 - DNA, 399 bp, Zea mays
gaggctatccgcagtcgcgactgcaaacaggaactgtaaatttttacagctctcacaaacgatgcagcggtggactgcaacaggaactgtaaatttttacggctctcaggaacttcacagctagcgcaccttctgcggtggactgaataatctccctcctctttctattggctgctagttgggtgtggaaagaaaagaggtgaaaataaataatagaatatatggtatatggtatagggtagatatttagagtaaatatgaccgcggagtattatgggatagggtagagaatctcgctgaccaggatgaaatattccttttagagtagaaatttagggttctatgagtgcggatagcctgatgacctgagcgctcccatgcggccatgtctgatgaatt

SEQ ID NO: 12720 - DNA, 214 bp, Zea mays
cccctcccctcccctcccctccctgccaaattcgccaccatccccatctatatccagtcctctgctcatcctatacctttgctttgcctctccttcacttcacttcaagtccatcgcccgttgcagcggccgcggcggcaaacatatcacccagacgcggacgccatagtagattagattgatctctccgtggggaggaagaggagcaagagcc

SEQ ID NO: 12721 - DNA, 213 bp, Zea mays
ctagctagctatctttctgaacaccaccacgggcaccaatccatgcatggatacagcaagacgttctggaggatcgtgcggggcgggacgacggaggagttcgagccggcgccgtacgtgttgacgctgctcaacgcgctgctgtggctctactacggcctcaccaagcctgacggcttcctcgtcgccaccgtcaatggctttggggctgtc

SEQ ID NO: 12722 - DNA, 500 bp, Zea mays
gtaggaagtttttgtttttgtgtagtgcttctagtctagttcatagaaaaggagaaaaatgttcattttttctgtcaactctttgtctctctctcttcctgtttgattaggaaacggttgactgactggcaaggtgtactgttctgaactggtcgaccgcacaaaatccagcacacagcagcttcctcatctggaaatgcaaggtacgacgctcaaaaaagaggcagttgtgtccggaggaagtaaaaatcctcttaggacagaggatcccgcttgcgggtctcccgaacatgacgcccgccaaggacgtctagaatctctagatagcccgtggagaaaaagggaaaagaacgagccgaaggttattttttcccctggcacctggaagaaaacttgtcctcagggtatatttgtaggtcacgattcacgacggaaacagtagtgctgtcacctgtcagtagagctctcccctgggccaagaactcgatccgagcaaaaaa

SEQ ID NO: 12723 - DNA, 1500 bp, Zea mays
ttaaaacatctagagacataaaggtacatattttttaaaaaaatattaaataaaaaatatgttcttgttgaaagtggagcggatggccaaaaaacggtatgtttggttcagtttttttcggatcagtttttctgaaaaaaaccataaacaaacagggcccaagtaaacagagtgagagctacgcagcatacaactttttttgcaatttttatcagcatattcgcttggctttaaacacatcatacaacttttgtaattattttttagtatgtttgtttggttttaatttatattaacttttaccgcttctacagtattttgtctctatatatggcacatataacagtctaaacaactagctttcatctgaagcgaataatcttatctttatccatcgatggggcaagtgtgagttgtgcctgtgcatagagcctctaaattgacgggactctattttttctttggtctattaataaacagcaagtagacgtcaaaaccaccactacttttttgtatgttcgtccgtctcacgctgtgatgattatattagaatacaattacatgatgattagattagaatacaattacaacgaagaggttgacacttttctcttagaacatgacgtcacagtctgagaatatgaggtcaacattgtatttactcttttaacattaatatttgatatgaaataatatacatttaagttatttaagtgattaaaaacatgcgttagttatacgggttgattcgctccgaagctgcatattactggagacagtcgtgatctctattaatggtagagctaaacaaaatattcgtaactcgtggttagcttgattcggatcattttaattttgtcatgagctgagctagcattttaactcagttcgttaacgagctaactcgttagttcgaatgagctagtatttatcatcaaaacaaagactacacttgtattggatggacaaataggtgataaactatgttaatttaggattttaattgatgtgatatatgaaattatgagtgttattactcttttctagtgttaaattagtataaaattaattagcaattgataaactatattcgattattcatatctatgtgaattgaatgagattgaaaaaaactatattttttgacttgtttagaaattaaatccactcaattcacatggagaaacggaccttcaactccaatccgcttcgcatgcggccccaccagtcaggctaaccagtttaccaatctgacgccgtcacaggtcacaccgtctttactagagagagcgccaatcctccccatcccgaccgccgcccccacctcctccgcggccgcctcgcggcgattccgtccgcatctgaccccgatcccaggggcatcgtcctcacctcctccgccagctgccgctcttccgtcctcttccgcagcttctgcgtggggaagaggcggtggcggccgaaccagcgtagtcgtcgccgacgccgctgccagccgcc

SEQ ID NO: 12724 - DNA, 995 bp, Zea mays
ctgcagacattgcatagcaggctagcagcgtcctagtgctgttattttaacaccatgttatttgaaaccgcgttgctttttgtacaactgccagtagtagtagggttgaattgaattccatcctttctatgtaatcccctctgttcgaaaatagctgacactttagcaatgaatctggacaaacattttagttatgagtctggacgaatgtttgtccagatttatagcagaagtgtcagctatttttgttttacacgtccacgtgctgatttgctgtatgtcattgccacagaacatgatcagactggatagatgggttgcattatttgcttacgctaggctttcatgtttcactgccccgaattatgtgtgattgtattagggtgtctagtgtctagtactctgtaccttgatgtcgctgacttgaccttgccccccaccgctctgtgcagaagatgctgcgtctagatcccagcaagaggatcaccgcgcgcgccgccctcgagcacgactacttcagggacctcgagcacgcctagcagggatggatggatggacggatgaaccatttcccctcccctgctccctctgtaaattacggtagcagccgcgatgcttggggccggcgagtacccccgtttgggcggccgctgagttatgtgtgttactctatagtatgactaagtaagctggagtgcctcttgcccaccatgcagtgcagttttttttctccgattttttttggctgcgtagagaaatgagatgagaaatgtgatccagagatccttgtgccatgggagacctagcactagctatgtagatgtcggcactggcctctcttgaacctgtatgatggctggagagagagaggagagacggtggcttctctggttgataagttggtcctggtatggtgtgcttgccgccgatgcacgtcatggtctttcttcctttctgatgaggacttggggtggacgccgagtgagttcgtgctc

SEQ ID NO: 12725 - DNA, 369 bp, Zea mays
cgctgaaattattgtttcctgccaaggcaaaggtataaatgtacctaaatattatgttttaatatttttgggttcatattaaaaaataagtgaataatgttatccattcttggtattttataatgttttatattttatatttcatttcgcattgttttatgtctgaccacgaagatgtgaccttcgtgatatattgcccatgaccttcggccgaagctcattaaatccttggggtgataatgcttcagcggacgaagggcattaacatttaacattctatgttgccttgttcttaattcatagcatttgagaacaagtctccaacattggcgcccacctccggtgaactcacttccactttttgagctg

SEQ ID NO: 12726 - DNA, 1217 bp, Zea mays
gcgactggggttgtccggtcctactggtcagcggggatatgtggtctgggcatggcttggtaatgtctcatcgcgtcgacgtggctcgatagcaccaggttggatttcctaagagtcagttgtcgtcttgctggattgctcggcggtctcgcctcgctggattcctcggcgagtggtttggtcagtagcctcgcctcgctgggttgctcggtgagcggtttggtcagtagcctcgccttgctgggttgctcggcggatattggttggggggcgagctggtcggcttggtgagccgtccccaggaggccttttggaccctcacgccaaggtgcttggcaggtgggtcgctagattcatgggttgtatttgagaggcctttaggccttcttttatgtaccctgttcctaagtatccaacaatattcgtatccgcatacactcttcgctacatacatctctcgtttacactctcgcattagaacgtgaggctatctctagcatacctcatatcgcatcctctatcttatttcttgttttaaacttctcagtatcgtctacagttttttcacgctacgctagtctgaccgccggatatagccatagtagcgaaaaaaaatcaatgaaaatgggaacatccatgcacatttctttacattttttttctttctcgcatagaaaaaaccacatattcccttcttctttcccaatctcactggcaggcactgcctccatcatcctctgactcagagagagagagagagagcagccgagccggttcaaccccatgaataccgctgctgcagagatcacggcctgcttctgcgtctgcagctccagcagtagcaacagcaggggctgcagtgcaaacgactgctagttcccctttccccgcatgatctctgccccttcccctaccttctcttgttcttgcttgcacgacccttttccttgtgcgctagctgccgcttcttcttcgtcttcctggagctccccgcatccacacatgccccaagaaccagacaataaaacaacacggaaccatcggagtctttttctactactatttccagcgatttgattatatggatgtgtgcacaggtgcacgtagataggtagaatagaagggagattatagctagctagaggcagcgagcagctcggttgctgggacacgcgatcgagctacagcaaagaagactgcagggtggcgcggcgggc

SEQ ID NO: 12727 - DNA, 1500 bp, Zea mays
ggatagagttaaacgaaccagataagagcatctccagcagttcctagttaatactcttaaaatttattttagcagaatattataaaaactatgtccaacagatcccaatatacactatcaaaatcagagcttcctgacacaaatatccgtcgacgtgctcacatcccaatcgttgcgtttttgtttctggggccatcgaaatctcttgactcccttttctagtctttttagcctttaatatttattgggagattctaatttaaagatattaagagattaattattagtagttattgaagatgctcttggtagataatacttatggctaggtctaggcaaaataaatcgaaaccgaagaaccgatccaaattaatcagaactaaaaccgaatgaacatctataagtttcggtttcatgtttcagaaaaccaaaataaccgagataatttcggttatggacctaaaaaccgaattaaccgaaaaaaccgaaatataatagaagcacaatagaccaatagaatgttaggcatatctcaatataaccttcccaaatcctacgcatataagcacacaacctctccaaatcattcgatctccaacgccaatcttcaatctggccatctacatacttttgttaaactttaaaaattgtgttgttttgcaatttcggtcatgaaccaaaaacgaaccgaaagaactgaaaccgatttttttttggttccgcttgtcttgcatgcgtatttcagttctaattttctagaaaccgaattttctaaaaaatcgagaaaccgaacggaacgaaagaaccaaatgtcggagcctaattagggttactctcgagcatgcagaaatacccattgccgcctggcggtagcagcgcggtccaaactgccccaactccaattttctggctttctgcacatccctgcgccctgccccacctgcctaccacccatccctgccggcgtgcgcaaaagcctgggcatccgaatgtcccgctcccgcgtgccgagaaggcgagaacgctgaaccgccgttttttttttcgctgcggttccaaaaaccaaaaactacacttccatggttcgtcgatggtttgccccgatctgcgccaggagtgatggagatggacaacaactcgtcagctcagccgacagccgcactcgtagtagcactaaaaaaaaggtcaagtcagaggcggcgacaccccgcgtcacgtgccgtcggtgcggcaggaacgataagcgctcgtcgcgcctagatctcacccatacaaaattcgtttgcgccatgcagacgcgccacgccaaccgtctctgccgagccgccgtcgacttcctgcctcagataaaaggttgatccttgtgtgcgtgccgctgatacgactcccgaccgggtccatttcggcggcacgccccgccgcgttccccaccgcgctatattgcgtgccgctgatacgagtccacatcgctatcgcgtcccacacgctcacagtcacagc

SEQ ID NO: 12728 - DNA, 273 bp, Zea mays
agctgtttgttggcacatctggtttggtgtgcgtgcatgttcccactgctggcagacactagcctgatttctgaaattctgagacaagcctctgtgctgacggctacgcgctaccttgcagatgctacaacaacgcctacttcgccagggtcggcggcatcagcctgtcggagatgaactacctggaggtggactttcctcttcgccgtcgggttcgacctcaacgtgtcgccggagacgttcggccactactgcacggtcctccggtccgag

SEQ ID NO: 12729 - DNA, 1500 bp, Zea mays
gtgcatgcaaactgcaaagataagggccaccctccgccacccacacatcatacatgccccatgatctatcctgcattggaaggatagggtaagggcgtggaggatcgccagatatgcttggctgcttgctgctacttgctagtggaacacacgaggaagaggttgttgcccacttggccttcccagcccgaccctgatgttgtattcatttcattccccatgagtacaaagtactctccatactagtttagaaactcaaatctccttcggggttggaggaaattaaagtaaaaataaactaatttcctctcccatcctctctcctcctcctctcgccctccgtgtattcatttcattctgttcgagaggccattagatgccctaacctgaggccatgtacccctgcagaccacaccggtctgcactgattgcacgccatccacgagtgctgctgctggtgggtctggccagtccgcatccaaggaccaaggcctgctttcccttgtaccctctcgcgaatgctccaaaagctcctgcaaattttctccagtacgtggtgcttgctcatcacaaccaaccagttctctctcacggtaggttcctgcagggctgatctgccgcttttcgctagctttgttttagtatcatggacgcatgattagaatttatagaaattaaagaaaaaaggggactccacttcgagttcgagacgaccggagctgcagacgagtagtcaagcaaaagccactgccgctctacctgcaattgccatgccaccgaccgactttactacacgacccagctgcttcatcagagcagctgaacaatgctgacctgtcagtcccgtggttctgaagcgatctactagccatccaggaaaggaggtctctcagatggagactacatgagctctgtacctccatcaaatggagattacaggggatatctgctttagaggccattaagctcgctaacgtgagttctgaccctgttgttcagcactcgagtccatgaatatgatgccaatcgtgaccgtcgctgtcagttaacattgtccaaggacccaggcattcttcattccctttttcgccggcaggcaggtttgtgccgttgcaacgagacggggcaccgacactccatctcatctcagatcatcattcatctaaagcttcctgattgtgagcatattcgttctcacacaggtttcatcaacagccgtcactcggtctcagcctctcagggatgggaggtgggatcggatcggaggccgggggagcggcaccggcgccaccgacggccctcggatcggcatcggacggacacaaacgtgtccccgtcggctttcgcgtgtccagactatttagccattgatacgccggatccaaggacgtcatcttcatctccacgctacgcctgtggctggcactggcacacacagtacagcctcatcgccacttaccaccgtctaacgaaaaagcttcgacgagcgaagcgaaaaag

SEQ ID NO: 12730 - DNA, 243 bp, Zea mays
tggtgtcctttggtcctcttcatcattgcagctgataccttgctttatcgatccttttcaagtcgtttctgtttgtaataactatgcaggtgcagattccgttgatcccacatctgaaaagcaggggagtcgacgaccctcatggttttgaggataatatattgcatctctgcactgttctaagcgtgaggaagtaaagcattatttattggttggagtagtttctgttgctatccggcacca

SEQ ID NO: 12731 - DNA, 247 bp, Zea mays
aattgaaagggagtgtgcccttgatatgttagggttgtttggtttcataaacgagcccctgagagtgtgcttggaaaggggagatgagatatcttgggttttttccccgggcaagttggatctgctcgtgcccaggagatttcctctttgccgaacacaccaccattagcggccggagagaggtaattttggtaggttatattatgtttaaggtatagtgcctaagtgtttgctttgttatttggta

SEQ ID NO: 12732 - DNA, 1500 bp, Zea mays
tgatggaatggtgctacctgccatacagcccagacttcctctatctataatatagtagccattcatttaccccccgtaaaactgatggtcttggtaaatgcagagcaggtcacacgggaatgtgggatctcagccagaggatcccaatccgcctcccctcgaccaacggtgggtcggaacctagcgctggatccggaagtgacgggctgcttgctcggtctgcagtgaagtaggcccgtcacttttgtgggtcccaactgtcaacgaaacagcacaacattccttggacgcgtgtagccgaaggtttatcatttccatggccgtcccgtcctcgcgtcgcccattcacatcgcataaaccccaccaaaaacgcaccaccaccaccactagcgttccgtccctgtctcgatgacaggtggggaccaaatacattggccccacgtgaaagcctgaggagcgtgcataacagttcttcaccagggaaccagcacgtcccatactctgactgcgggggccagcggcacccctgggtccacgagtcatcactgtgtgcgtaacaaacagccttggcagatcctatagtacgtccagcgccagcgcatcgcggccgtcctctcctccccctttccgttaggcagataatcctccaatgacgcgtgggtccggacgagcttcgggccgtttcggcagtgtgtggagctggatcccggacgcgtgcgtgacgcgaaaggtctcgcgtggtgcggcggagggggcgggcagtacaggatggggaagaatgggggattattaaatatcggcggacgaggggcgtggcctgccccttttgctcctgtcgccgctttgggtcggggtttaagcgagtgttcagggaggccgggacggaggcgacgacgacggacggtgccggcgtcggaggagaagaaagaacaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcaggtccgtgccccccgctctctttttcctccgtgttttcgccgatctgggaggtttttgaccgggttttgtggccctgttcgtccagatctggggagttcgtggctgctccttccatgggttttgacaaaaaaaaaatctgctcttgtggttgcagggacgggttcggggtcaagtattccggattcctccacatacggccgtgcggtttctgtagaggagactgacggattcgtcctcaaggccgtgccgtttctgtagaggagactgacggattcgaccgatttgcgctcgtctccgttatatttttgcgccagagtttttttgttttttttcttcagaagcttttccccgtagttttggctggagttctccccggcagaggagatacaagagac

SEQ ID NO: 12733 - DNA, 1333 bp, Zea mays
atgtaaccattatatattaatattttgtatgttgttgtaacccatccccactcttagaccctcattaatgtgaacaataacaaggaatggatgcccaggaatcaagctcatgctgcttaggtgtatgggaggataacgagatgtgtagtgctcttcaagtgtgcaagtgcgtctatgaactgtatggttctttgatttttgttgttcgctgaggtgcaaagtaggaagaaaatgcggccctaatcttacaagcggggaatgtatcattttttggtgcaactaaaatatgtggtgttattttttgtgtactaacaatttgttgaatattttgtatacygttgcaacgcacgggcatctacctagtagatcttaaggctatagatctaaatacaaaggaagcacaatccaaagaccgttagtacaacatcaatgttaaacatttttaaaatactttttttatttcttatatacatacacgcatacacgtatatacgctcctattggcgagataaggttgtagttgccgtattattattgcactctgtttgttaaacgagatgcatgaaagataataaggtcctgtttgtttatcttataaattattatttaaattaaattacgatggaatggtagaaaggtaaatatcacttttgggattaatagcttattttaatttatttatgatgacaaagtgacaattcactcctctactatttcaccataattcaatttaggaggcaccctaaatctatgcgtttcatgcgtggcgtacggcggtggaaacctaaactacagtacagatacagatgcagcaaaaaatacaaatgtttaaattggtaaacttttgcaacttttgcgggtcaagttatttcagaatttattttaaacatactactacgaatacaaatgcaactacgtgtatgcccgtacggatacgtacacgtacagttactcaaccgccgcttcgggcccgacctgtctccctctcccggccctcgacgctcttcctctttcttcctcctcgcgtccttcttccctcgcttccgtttcctttcaaaccctaagtccgattacccgttcaaaaccctaatcctagctccccagcctcctccccactgcgtccccacactgctccgcgtcatacctcgcgacttccgcgcccccgcgcgcccggccctcccactcggccctcgcggacctagggtttctcccgggccggagctgctcgttcgttcactgcctttgggcgagccggtgcgggcgggtggttgggcgaggaggtggtgggcggagatgagatgaggttgcagcggctgtgggggcggtgtgaact

SEQ ID NO: 12734 - DNA, 370 bp, Zea mays
tggatttttttttacaatttcgaaccgcacaaaatagatgtggcacgtttaaccataacgtccacgaatcgagatctaaacccaagggcagtcccgatacggcccctaataattaagaaccagcccgatctgaaattcaatcataatagaccttttcaggtttagtttggattgggcagcccttggattacgcggtcagggcccaatacccgtaattcgttatccgtaggccgacgaaggccgaaggccgaagcccaaacccttcgaaaacccttctcccgtcctgctcactcccgtctccgagcgccgccgccgccagcgccgacacgcgataaacaagaggaagaagaggccaaccgatccakcascg

SEQ ID NO: 12735 - DNA, 644 bp, Zea mays
gctcggtacccctgttatgatgatgccatgagcccatgagggctcgctggctccgggtggaatcgaaggcgcgcgccatggatcagcaagaggaagtggtgcgagcaactgggatttgggaagcgcacacgcggactcgcgacttgatccatcttggcatccgatcagtaaagacgacaggcatatctgtaccatggattacggaacaagaacgctatgcttttgctctacgacgtcgaagcgagggcaccacaccgacggacgatcaattttgtgcattaacgccaacttgtcacgctatacagttgtttctcatgtatgaaatggatatgatattttcgtatccatgacagcgagtcagccacagacgctctcgtaaaacttttccgaaaaatatcctctccttttttttcatcagactagacatagaagaagtttatacgggagaataaaatttctcaatcatcaggagggagaagggcaaaaataaaacttaaaaaaaaactacaggaaagtgcacgcagtataatttaaacagccccacttccccctgctctcccaggaggacagtcccgttcccgtcagcagccaatagccagttccccgggccctcccgggctcccctctcccgctcgcaggcggcg

SEQ ID NO: 12736 - DNA, 400 bp, Zea mays
ggttgttttctaattctggtcgtgttttgggggttttgaaagttgtagactgaactctcagatagtagaatgaggtaataacaaattaatccgtttgtcatctactcaggctctaatttaatttaagcggagggaagcttgatcgatcagtctgacactgccctcgttaagttatagcaaatgcctcccggcttcgacggatgcaaacaatgcgatccaaaagctgtacgacgtctgcagagcctcactgtccgagaaggggcctctatctcctcctgactctctcgacaacgtccgtgctgcgttaggtatgtaaggactaaggcctgcctgcctccctccagcaccttcttggttctcctgatgatgatggcatgcatgcatgatctttctggcagac

SEQ ID NO: 12737 - DNA, 157 bp, Zea mays
tcggaagctgcctgctgctcttcttcttcttcttcgctgctcctctctcgtgctcctcctcctgctctctctactactctgaagaccatgcacgaagtgaggggagtgagactgggagagaggaggagaagagttatggagggtgactgggtgagtg

SEQ ID NO: 12738 - DNA, 779 bp, Zea mays
gaactgaatctgaacccgaaaagaccaataattcggtctatttggatttggttcgggttcgagttcggttttagttttaaaatgtccatccctagcagtgattgtgtgatctgaaaatcgtagaatgttccgagtgttcctgaagctactctgcttttcttaacatcaagagagctaagtgtgtgcctactaatttccctccggtcttatcctcatcagtcctcaactcctctctctctctctctcaacgcacctttaatgcgccgtgatctctctcctccaatcccgacaaagtacaccatcgtctcctgtcttgatgttctctctctcgctcccccaccgtcctagtcctatcatatgctcctatcttctccttcccccggcaatcgtcctagctgcaacgcactagatctgtcgacaaacccaaccagaactccataaaatagtgtcgatcaccacaggcaaacctccctccccgtttctctctctttcactctttttctctctccaagaaataattgactccaacgccaagcgccacaagcacaagcccttgcttgcttgatgtcactctttcgctctcgctagctctaacgccaccgctgacggcgctgccgagcctccagtccaccgcccaacgtcatacaccaagtcaggtcagcagccccacaagaacacttcgtaggtcagcaaatccattattagtaccgatatttctccaggtccctgaagagaaagcatcgtcttgtgtatttatatataccatggtctaatcggct

SEQ ID NO: 12739 - DNA, 163 bp, Zea mays
attacgcctgagtttagatgtacttggcgagttacaatatatttatgtggtgtctgaaatgttctagaacctctaaatctattactaagagcaacgatattgtcgcttcttaaaccttagtactacggatgttatgagctaataaatatatttcgctaatgtg

SEQ ID NO: 12740 - DNA, 738 bp, Zea mays
cgttttctatttttccatataaatatctatattataaatatctatattatgattggtatagaatataaaatataaaaaatatgtgattaggccccacaaccgattttttttcatacaaggagtaaatcatacttttgtttctatacactctccctacccttctttttgatgagcgcatgacgcatgattaacttgctgagttctcgtcatttgcatatatccacacatgccaccgtaccaacaaggataatctttgctgccttccaacgaggcaacgagccaacgatcactgtctgtctgtctcgcaagtcgtaattgtgaactcactaaaaaagcatcacttaatcagtctcatatgcacgacggccgagctagcgtcgtcgctggctggcttcgatgtagaggtgaagcaaccattcgaactcaggcaagaaaacgaatcgaccgtcagcgtttaaacaacactagacgtactcttgctcctccgcgcgccacgcccttggcgcaccacgtctacccgtccccgtcatcggccactgtcgcgccgccagcccgcgcgccaacacgcacgctcgcgccgcctataaatccttgcaccgatcctcccgtcccgggagcaatataactaactgcacacacgcacaagtcaaacttgcagctgaggaatcgatcgcatcggtatcttgacgtgttcgttgcccgattctagctactagtccccgctggctctttgagcag

SEQ ID NO: 12741 - DNA, 1322 bp, Zea mays
tctccggcaacaaatctacaaccaaaaggctcttctcgcaatcaacaaacgcggtctcggatcctcaaaaaaaactgccaaattagacggaagcaaggtggaattccacagaaatcttacctttctattgccaaaccctgccaaacggaccaattgaaagcaacaattcaagagcgccgctcctctcaaaccccgacaggaagcaaccaaatccccaaagcctggaggaaggcgaggggggagagaaaagccaactaccccaagtcaaaagcaagcgaaggacagagtcacagaacggaaaccaacaaggcaacgaagacgcggtcggagcagcgaatctgcctctttctcgtgcgtgcggctggggattgacgaattgttgggatgcgtggaacggagtaaacgaacaaactgccagtacagtacgcttaacggctcaggcaagggaaatgaacagcaaggcagcaagcttaagcttctggtctactaatcctttatctttccgctggcgtggtctggtctcgtggagcaggtagtactaaagaacgagaaatcaaggctcaggcagtgctccactaatctttttgattagcgtgtatggttggtttgtgggaatggctacgcagctgcgggtatgcgggacctggtcggcgtcggcgggcgcgtgtggtgacagccaagacgcgggcgccgcctgccggccgatgcgctgggtgttccagtgcgtgtggttgtggtgtggaagcaacaacggtggcggtggttaacgccggaccgccgattgtgagcgcgacatgcccaaacggggccgtccacccgtcctgcgtcagctgtcaacgtcatgggctcatggaaaagttaaacgagcgctaagccgccgccaccccgcggattaggttagggtttcccgcctcggctgcgtcgcgttcactctctttcaacgccgggccaggccgcgcctcccattaccaagtgggagtgggtcgacttctatgaatgggccagctaggcccatttgttggcccacgtgcaccctgacttcttgactggatgagcccctctccgtgacgtgcgtcgaccaatcagcgcgtgccacgtcatgctcggggctctcaccgacgtgcgggccctagcccgtcgaggaggatcggcactgcacgggctccgtaagcacttcccgagaaaaggaagacagagaaggaaactgcagtgaagtcgccggcgccgccgcgacaggaggaaggagggagtagcagcggcaggggaggcccggcgatctcttctgytgcgtgcggcgagggagtaaaaggagccgcgacagg

SEQ ID NO: 12742 - DNA, 1279 bp, Zea mays
atctaaaatgaaggacaaacatgaatctagcaagcacaagggcaagcgcaagtataccttcagcaagcataagtccagaggaggttctacaaggaggcactcaagaagaagtatatgtggtgttaggaccttagaggaacatatctacgaactcgttttggcagatttaaaagatttcgaacaaagtttagaaaatctcgatccccaaaggcacattaatattttttaagttgtttttgggtatagtttctaaagcaattgatacatttccatgtactaaagccattcttttgatttcaactgcactaaatttaataaaagtattcgcaccggattagttgtatttggactcatcacatgtttgattagaaccaatctttttccatgaccctctccttcatgatacttactcttgtcaccattacatgtctctactcctttaaagcacgagttttgtgcgtcgtgcatcacacgcgaagcgcgtagacctggtttccctcacatctcgcctaacaactagataagataaaccctaccttttcatacgcaacgaaccatacaccaccatgagcgcttcctcctgctcctagcttcgtatattaacctccaacctcccatcacttttccgtttccgccttcgtcatctagattcttttgtaccaccataaaggacatgagcaggctgctagccttcgactcgccatccgccgcagctcctctcccgcggtgccacctttacctttccgtgtcggtaagtgtctcaaaccgctgctatgactccgctgccatacgcctctgtaggcagtagggcaagaacagacgagagagaagaggagacgccgccgccgacgatgcgtggctgaacagccgaaagagaggagacactctggattccaagtttagtttttttattggttgttggtataaaaattaagagatattaaggttaataataatatatttatgactcgtttttatatattttatcgaatatctgtgtattgttgcaatgcgtatcatactagattagttaggagtatcacttaacatgcttggtgctaagtgtaacaacgggcctgtaacagtggcccacttaaagcaagagtagcccagctcaggactactcctctcctctcaacctaccctaaccgccgccgccgcccgccgtcctttcctgtataataaaacctcaaatcgtctctctcccgtcctcccctccaccgccgcagccgccgccgtacctcctcctcccgcgcagtagccaccgccaccgccggaa

SEQ ID NO: 12743 - DNA, 1500 bp, Zea mays
cagccgaaccctatgaatgtaactactagtagcattaaccgaaggccgtctccctgactcgttccttattttcaaattttaatctccaaacaatatcaaataatatcatctagagttctacgcccctattttatatgacccaccgaaaacagcctaacgagctgacctaaatcaccatcttaatatatttgactcacgattgccctgtaattgtagtgtcagttattggtgatgatcatacattattcaaaggtagacaccgctcgtactaaaaggttccaaaagcgtggctattctctatagccaacccaatataccgggtgtgctttagtcacacaaaaaagtgagactgacattcatgtgatccttcggttccaaaggataaaaaatatttatataaacaatatgtatctctaagtgcctcaatttaccacgggatattcatttttctaagggaaattagtttatctttccttgaaaaataaaaatcacttaaaacaatgtagttccaaactaaccctaaatattaaaaaaattgacagtatttaaacctaaatatttataattaaatttctggtaatagaagaagacaggctgactctcgtgcgacccgatttcattccaatcgatcgccatctgctcagctgtgatttgtgagcgcaaagcccgacatctataaatatcccgcatccatccatccagccagccattgcaaccaccggccgggctgggagcactcagcactgcgacgaggagagaggagacggagacggatgcttattcctgtgcctgccttggtgagtagtggccttcgccttggcctccgcgagcgcatttttatatgcttgctcgcccgcgatggataccaaaaccaccgcagcggcgccgctgcggtctcccacctttaatcactatacaagcttgcttttttctctttccccggtggtgcgggtgctggactgctggcctctgcgtccgcgtccggcggcaagtgcgaaagctgccaacttttttttttctgctcggtttgttccttctccaaccatccataccataccagttcttcgcaagttcgcatccgaactctacctcccacctgcacagcgcagcgctctttttttatgttcttgcgcgggtgggagatggatgccctgtgtttcccatcggttgctagggagattgtagattcagatttgctgttgccctgggctccctgttcttatgtttccttcccggattctactgctgtcttcttttctagctgcgaagcgctgagatgaatccgctgctgctgaatgtgattgtgtgtgcgattattgggccctggcaggtgagtgaggcgctgctggtatgcatgagctaggaggtaaggaacaaccatacgagggcgagcagagcagagagcacacggcgcgccgagctagcagcattgcccaatctcgcggcggggagagattcgtgagcgcggaggcgcgaatcttcgacgcagcgacggcagcc

SEQ ID NO: 12744 - DNA, 406 bp, Zea mays
ggtttgccccagcgccgtttcctgaatccccgcgtttagctgcaggctatatagccatgatttgcttgaattctcgttacaaatcatggcacctcttctaattcgtattccgctcatctaggctgctacgttttgccatcataagggtcgttaggagatggtagaattgaggcttcctatgttcagtatacaataatacggccctgttgtttccatgaacgcttgctacctcgtccagaagtccctggaacagtagtttggacctttgaatccagttcctcaatagattgccccatgtttgaagagatgagtcatattcagtaatcagtattcagtacccactaaattttccaacgagtttaaatatcttttatccattcacaggtagatataatttgatgggaag

SEQ ID NO: 12745 - DNA, 1500 bp, Zea mays
atacagtagccattttcctattttaggtattcacatgtacaacttttcttgtcatatgtatgccatggcgcttttgtaaatgttgcttcctttgaacaatttggtgtcaccttgatagaggtcagaactattgaaatcaagaattcatttatgtatctcaccattttcacgcccttactacctatctgctctttttgtgagcgatctgtcatgcacaggttgcctgttattgcaacaaaaattctggtgtaacactttttcagaatccatccatttatgttccattaactgcttattaatgctcaaattgaagttctcacaagttgttatttattcgttaccacccggacatagaaccatatgtaacactttgtgttcctggacactatgctgactcgcagcatgcagttgcttctcgcaatgggcttcacctacaaccaggtcatggaagcctacaacatattcgacgaggatgtggattgtcctgtgtgggctctcttcctttgaaaaccaacttgaagattgggaattagcatgaaacaaatctttacacaattattacttgcatggacgaagtatggctgaaaagaatgaaatataggagaatcctattgttggggaggtagatctgaggcatttgataaaggccaattcgatacatgagcatgcttcaaatgaagggccaattgctaccggttaaacataccatttgcagtgtttttccttagtgttttttgatattttgatcgattttggctgcaaaggtctactaattggtttccagcttactaattgattgtttttgcatattagtttttttatcaaattggtttcatagcaacgcacgggtatatatatatatccagatatttttatatggaaaaataatgcaattgaaactaataaaattttgtttagtgttaggaaattcagataaattgtgttttaccttaaaaattatgaaactggtttaatttttttcctcttcaaaattaagcactatcttattgtgtctagtttaaaattgattgaattttaatagattttgttcttgttgcttcgttaccaatttgcatacaataaagtctactcagaaacactagtggggtcatgcgaccaggagcccggatggagctggaaaggagtcgtgcgactgtacactgtagccactcgcgcgctagaggccggagctggaaggatcaggagggtgtgcgtgttcccgaatcgcctggaggcaggagcctcgtcgtccggagccacagccaacaggcctcgagacactggcgggtaggcggggcccgaccgggataaggtgaggagccgctgcgatggcggcccgtgtgacccccgtcgcaacgcacggacggtatataagcataaaggcatttccgcgaactcgcttcctcgcgcgctcccgccacgtgagccagcagcactccacactgtatgatcgagcagctacgcgcctggacagactcggcgcaggaggggatcgggagg

SEQ ID NO: 12746 - DNA, 798 bp, Zea mays
ccatggaaccagcacaagcatgcactaattctgttgtggatctctacatgcttccaacatgccaaaaagctaggtttgcttgttccatcggtcacctattccccctccgcgccccctcgtaatcacttgccatgacccagcgcaacaagaaagacaacaagtatgcaactaataatacgatagatataatgttgacatgaaacagtatgctttattagtatcttaagaagcattccagtactatagctttgcacgcaaaagtagtgccgctgccgttggggctccaaatggtaacagctgagccactaatgctccctactgaataagttgggatcgagtcggatcgcttgcttgtcgtcctttaatttcctctctaatcaccatcgaccagtggatgctccgatcacccgtcactaagctagctcctctcctcgcctcatgcatggtacgaaatgactcacctcacctcggtgcccaacaacatttcccatccgccttcttcctcctcccccattggctcagccctgcttagccgacggcgtatcgcactagctagctagctagcctgcctgattatccatgtcctgcacacaccggaagaaggcatatgctcttacgaggttcccgtgctgccggtggtgccccggccctgccgccgcacgccttttgcgggtgcagctagctagtatatatatagcttccaccgcacgcgtctgaggccgcgcctccccccaactcgtccagagttagttgtagctatagacctggttgttgtagcgcacgcagtagccataggaa

SEQ ID NO: 12747 - DNA, 144 bp, Zea mays
tgctttagatccgcggccctgttcgcaccttgctcgcctcgcctcgcctcgccttccgctgcttcccgcctctaaccaccacggcatccagatcccgcgactccacctccactcgcggcggcgtgccctcgccgagatctcatc

SEQ ID NO: 12748 - DNA, 549 bp, Zea mays
cgacctgcagcgtgctcctgttcctttctcttgcgtagagaggctttcagggaaaacgctgcgcgcgcaggagcttgtctgtagcctgcatgcaagcggagggggaggccgccttatctaccttaccattaatagagaagaccgaagacccaaccaataagattgggttcagcggttccccctaaattttcccctctaaatcatttttttacgtcacatcatcaacatttgaccccctattttttcatctcccgcagcggttccccctaaatactccccctataccctactaccaccataaaatattattttacctacttatacatcacccttatcaatatattttgtactgaaaatacactgttgcacacgttgttcgagggtagggggcgactcgctccccgccagatctggcgagccactgtagcctacgctaccactgtagctgctttagggctcaccgttgcatgagatagcgtcgttccgtggccgcttaacaaaggggagggggaggtcgcggcagccgttgaaagcgagcagctcaacacc

SEQ ID NO: 12749 - DNA, 1500 bp, Zea mays
atacctgtcttgaacccctatgagcaggcatgatatgatcatcgtcgttgtgtgtattcatgagaaaagaggggcttgtatatgagtgtccatccaaagcatgcatcgtaccatgagaatcaaccgcactatagcctacgtcggatcgagcatgtcagagatgtgcatgtccatgcgatgttggcaacatagtaaatctaggtgggcgcacagctcctcgagcaagggtactgaaaagcagatttcgatggtgagtacatttctccactcagatcagcatcgtacgtggcctgagtttcacgtacacatatctctggcgcacatcaggatcatatcacttatcaggtccttctggtattagtaataattaagtttgtctggcaatagggctcaactgacctgtgtcttgatgacattgtttcgacaggtgagctgatcgagcgcgcttttgccgtcatggatgcagccatttctgttgcagcgaccagtaacagtaagcatatatatggccattattcagcacatatgcaccctccagttctctagcatgaacatgaaaacatgggggacagaagaacaagcaaactttagtccgagtcagttgctacgctcagtgttgggacagtgaatcctggcaaaagtatacagtacattggacatgcatggattagctgctaatcacgcaggcacaagcatcgaggcatgcatgcagccaccacccccggaccccggcaaatctacatcggggctcgtgtctgaacgtgacgtaaaccgtcaaagggaagtcgcggggcaacaaaaaaaaaaagcgcgggaatcgagtaccaaccttggggccctcaccctttccaacgggagctgactcggcatcgctctggtggcccacaaagcgcccaatagccatccatcctacacagtcctgcggctatacaccagctcgctttggctgccaaagacaagaagagaagattgggatatttctactcaccgatataaagctactgacacaggacacaacaaaagcaaaagccaaagtttgagagatagagagagagagagggggcagtattagcttcatgtgaaagatgacaagaatcccagcataaaataatgtcccaatctttgctataaagccagagcctccgccctcctttccctccctccctctctccttcctcatccgtccgccattagccaaggtctcctccccctcctgccgcctcctatcactgcacctcttagctaattgcatacgcatgtgatcgacgatcttggttaatttcctgcgacttaattatgcctctctgttatttcttgtttcaggttgcactgtgtacattatttgtagctgaccattcattcatatagagctagttgagcaggcctggttggctgtccataatttttgcttcggatagcattgctgccaggcgactgcaaagctccaagcagacttttgctgtgaggattttttttttgcgaggaagggcagagggagca

SEQ ID NO: 12750 - DNA, 820 bp, Zea mays
tttgatcataatttatattcgaaatttaatctggaatttgtctaattattcaacacctccttcagatatgttttttacttgaattctttctagattctctttatagctagatttttttcaaaaaaattattgaagaaaaaaaactaaaacaaacgtgcccatgatatggtatggctacttgccgggaaattcgtcgcgagtctgccgagtcgtaacctgttcccaacaggatctcgctggcaagtggggctaactactgaaaacgacccccgcgacaccgtgacagttctgacgagaaagctggagcgcagcgagtggacgaatcgcgagcgtgggatccgcggatccgcaccccggccgtgaccagcgcgccggcctccacctccacacacgctgacaggcggggccagggcgacatccacgcggttccttcgtcctggcttctgctgcctccggggccgggctccggcattattaaacggcagcagctccgccttgccttgcctccccaccaagcatcaccacgcatttgacgcggacgcgcgaggaagcaagcaccgccagagtcggagggaaaaagaaaaaagagcacggacgattcgcagctgcagcctgcacaggcggaggcgaggaggaagagagagccccccacgatcggctcgccgggacggccgacgggccgagggtgcggtagtgcgggcgcgtggccccgcgcgtggagtcgggatccgtattgctctctagcagccggccggtggcggcgctcggcgtccgaggccagagcccagagggtgactgacagagagagaatcgtccatcc

SEQ ID NO: 12751 - DNA, 678 bp, Zea mays
aatttggccatgcagatagagaattggatctgccacattagaattcacgaccaaaggtgtctccgcatccaatcaacacgtaagtcccctatctaggaaggataggctggttcactcgaggagaatattttctatgatcataccccaccaaccatgtcatccatgaacaggctccgtaagatcctatagagtataaatggaataagtcatgtgatatgatccaattcaatttttattacacttactttttattatagtatggaaatgcattcattttctttgcatcgattttgatccgcaatactatcggagtaaaagaagggatctaaggaagaacgcaggctaaactttttgattttttattagtaacaagtaaatactttgtttggacataagaaacttgcgatatcgaggggataaacaacaactaatcaagagacaatccacaaagcaattgatcatgatcaaatttgtaagcccacttggatattgagcatttaagcataagaataggattcttttcaatgagtagttataggcgcaacttcggaaaagataatttgataaagttttttcttaccttgagtcattgagtcattatatacccctattctattgtggatcctccacggtcttatttctttcattcttgctcgagccggatgatgaaaaattctc

SEQ ID NO: 12752 - DNA, 143 bp, Zea mays
ataaatactagtagacgagatatagatcaaagaaaaaattagtagattttgtctcacgtatatgcttaaaaatcctaaatttaaagaaaagggaaaacatgttgattatagaaaaattaggaggaacctagaattagagtctt

SEQ ID NO: 12753 - DNA, 113 bp, Zea mays
atagaaccccaaaaaggaatattgaagataaaaaacccctggtttttctttctggaaagacaatatttctttcatccttttgcattgaaataacaaatggaaatccaaataat

SEQ ID NO: 12754 - DNA, 1500 bp, Zea mays
ttggttccggcatattgctcgttcacgcactgttcgctgattagattggtcaccggtgcaggaattgccgtgtgtgtttttatcttgctcatcggtgtccggagtctgcctccacgggttgtattggcccgaaccctatctttgtaaccatggataatggataggattcttacagaatgcaacttgcatggctttattatttctaaatgtccataaagcataacgaaatgtttctacaacatataagacctcctgcccaaattaaaattcgttttagattagataattagtaggtacatacaatacttgatatatatgttttatgtgtcttgatttattatcatccgtttgaatatatagatataaaaagagctaaaacgactactcctttagttcaaaaatgaactagcggacgttcattttttctttagggtcaaaaatggaaaaaaaaaacttagtaatgatagaaaattaactaataaccaacctattgcttcgtattgtcgagatcctaactaagaaacagtcactatgtgaataaatacatctatcaaaaatgagtagatctatcatatagttgtagcaactgcatttttttctctacaaaagaaacctgattctaggctgtgaagcaaaactaaagggatgtggataaaaggagggatgatagatagaaggaagaagaataagaaagatataggattcccatatgtatggtctatgaattacatcataaaaaaaaggcaatgtgataaagcatcaatataataaaattctcaaaaaaaagagagaattcgaaatcgtaacttgacttttgaaacaacaaataaaaatataaagcaataaataaagagcagccgggttaataaaactgagaaaattgactcggaaaaaaaaattggaagctccattgcaggattcaaacctaaccattaaaggagaagctgtgggaacgacaaaacctatgactacataggattttattgaaaagaatcctaacacttcattgggtgggatggcggaacaaaccaaaaaaattgctttatttgataaggttctaaattaacaaataagacaggaaagagtaaatattcgcccgcgaaatccttattggattagaatactttaccacgattcaataagaataaaaaaaaaggagattccaaaaaaggaaggattacattttatataaatattgaatttggatatattctagatcttctttcttgactatatatttatttttcttttttaagtttaagaaagtcaaaatcaaaaaaacctaactttttctattatatattgatgtgtatctatctataatatttttgaatattatggaattagagaaatgacattcgcacgctttctcatttcattcgcgaggagctggatgagaagaaactctcatgtccagttttgtagtagagatggaactaagaaagaaccatcgactataaccccaaaagaactagatttcgtaaacaacatagaggaaga

SEQ ID NO: 12755 - DNA, 122 bp, Zea mays
ggttcttacttatttggggcgttatttctatctgttgtttttcctgtgcagaattttcattaatctttgtttgctgccctttacagatattggctatccgagcacaagtggaggagattgat

SEQ ID NO: 12756 - DNA, 337 bp, Zea mays
tctagaaaagaaaaaaatatacatatatcacaacttcttttagaaaaaaaaagaaaagaacagtggaaaattgtacatcatgatggagaagggggggggggggtggtgttcagaggctgatccatcctccggtgagaaactcaaaaattttccttctttgcaggtaccgagcagggggcaaccagcatcttgattcttgacggcgtagacatgcatgtacaacgaacacactcagccgtcctccatccagctcgtccccgttctgttctagagttgagctctctatcttctcttcttgttctgcaaagacggcgcagccgtatcgacgtgccatacc

SEQ ID NO: 12757 - DNA, 434 bp, Zea mays
ctcttatctcagataatttattagtaattgccatgttgtatagagcaggcaagattgattctgttggctagagtattgcatatttttattttgtttgtacatgtaagttgtagttacttaatcaaaactgaaattaagaccattacttgttatgggtctgtggcagcagttacacatttttgtattttaaagatttttagtaattttttgctttgtttcatggattacattattataactactggaacgatttagtcgactgtcttaagtttcttataggttacatggggttctattgctcctgcacttgcagccttcttaacaaggctagtcatgttgcttgcatcatgcacaccattttaactactcactgttccttttgaatctcaattagctctgcatatcagaggagattttcttatattttggtgaag

SEQ ID NO: 12758 - DNA, 889 bp, Zea mays
catagttccatctaaaattcgctaaaaacaggttaagatgtgtttttagttttccactacaagaaagtcgacttttaaaaaaactgctttctggatcgagtcatttggtttgacttttaagggataaaagacaaaaccaaaagctaaaccaaacatacctttagacgctgagtgctaaaataaaataaaaatagggttttgctaaggataggtatgcaaaccttgcaaatacctatccaatcaaaaaatgggccaattaggccacgtaaaatgcataggggagaaaggctaacgattttgagtaatctctcaatcagtcatctgttggagagccaaaagtatgcatacggtccatacatattatattttataacgtgaagaacaatatagtctatcatcttttcactcattactttttgtttggtttgttgaatgaatgagttaatctatcactattttattttttatagaataatgattaataatatatagaacaatggttaataataatatgaggaatggatttattccattaaatttatgaaatgaacttattatacaccaacttatttaaaatggtttcgaactaaacaccctattaatatgggtagacatctagttgtatgcctaccgagttatgcgtggccttgttgcataaactgtacaccgaaggcccgtcaggataaccaggccatcctaacgcgaaaaggcccacagaggatgtccaatacaaccttaagcgctagggttaggttttagctcctcctatataagaacgccacgtctacgatctccttgccacacccctcacaaaccacaaacacatctcgcggcggcggcggcggcagagacaggcggcggccgccgagcggcgtgggcagcgtcatcc

SEQ ID NO: 12759 - DNA, 1487 bp, Zea mays
cggatacctcactcgtcaccttccgtgagaagcagctctcgctcgcacaaacwattctgttaccaacaaaaaagtctgggtactcgaaacaagaggaaaagagatgcagctttacaacacggcgagggtgtgttttggcctcggcggccgcaggaaaacacacgctacaagacaatccgatcctgcaggctcggatcttgacgcttgaagggagcagcagcaccctcggcgtcgacaacaacttcggagaggtccgacctagcctcggacggcgacggggtccgaagatctccactctgaaggatgacgtcatcaccacgcccgggccctcgccgccagggtcttctccgggaatccggcccgagcaggcgactcggccggtcaccttggggcctcggccagctgtcctccgaggacgtcagcccgacccgaggcctcggctggtcaattccggcgtcggtcccgctaacggacgacccggccaggctccggccggccaggctccggccgaccaggttttcttttcgaaccaactctgcctctattcgcgctgacaccgctacccccggcctcggctcatcgaagggcggccgaggggttcctttaactgagcaagagaagcctcgggcaacaaggccgaccgagccgagggactcctacgcctccgggatatggatacctcactcgtcaccttcgcacggggcgactcacgcttggtgaagcggttcagacaaccaacaggcagagtcttcatgctcgaaaatgaagaaaaaacacggctccgtgccgaaattacatacatgttcaggcctcgacagccacaatgaacaaaatggcattcaaagtgccattacaaatggaactctggttccacctccgcaggtacgaacaaccccactcgatgggggggcctgcggagcaaccgaagaccgacgaacggcgcgccgtcgcccgctccagtagcggcgacgacgacgacttctgctccggagggccgaacagcggcagcgatgacctcagggcggatgctgctgccaggaggcccccgcccatgcccaaactcgtgaggcaaggacgggcagaaggccgtagagttggaggtcggtctgtgggcggccctggttgccccgcgggcgggagaacctcttccagctgccgtgrcagaagacgacgccgagagcggctccgaagccactcgcgtccgagagccaggcacgcggcagctgccggtgccacggacaacaaccgcccttccccccgatcactgagggaaggagcgggccaccgcccacgcaggggccgaccccaaattgggcacactccccttcccccagcactggtgatgaaaatccttgaggctgagggaggggcagaggccggagcccggctcgctttcccccaccatcaaactggaggtcaccgtcttgggtgaccgccggtggaggggtgcagccgggctgcatgatgaaaatccttgaagccgaacg

SEQ ID NO: 12760 - DNA, 1500 bp, Zea mays
gggaaaaagggggagtttttgaaatcttgaatcaatttctcttgtaatgactctctttatgttttaacaagtatgtttgacttagagatagaaatttgtgtttgatttgcaaaaacaaatcaagtggtggcaaatgatgatccatatatgtcaaaattgaatcaaaacaattattgagttcttatttgaattgattttgtacttgttctacttgctttatgttgtgttggcataaatcaccaaaaagggggagattgaaagggaaatgtgcccttgggccatttctaagtattttggtgatttagtgtccaacacaagtgcctaagtgtaaaaaggtggacaaagtacaaatcaaggataaagttatgtttctcagacttagtacattgttttatggactaattgtattgtgtctaagtgctggaaacagaaaaaatcgagttggagaagagatggctaagttcagccaaagtctgctcagtctgggttcaccggacagtgtccggtgcgccaggctggctcgagcgaagtggccgctctcgggaattcaccagcgacgtacggctataattcaccggactgtccggtgtgcaccggactgtccggtgagccaacggtcggccgcgcgatctgcgcgggacacgtggccaggccaacggctagaaggaggcaccggactgtccggtgtgcaccggacatgtccggtgcgccaacggctctctggctgccaacggtcgattgcgccatttttggaaggaaatcgggcaccggactgtccggtgcgccagtcgacagaaggcaagatcagccttcctagattgctctcaacggctcctagctgccttggggctataaaagggacccctaggcgcatggaggagtacaccaagcattcctacaacatttctaagcaccaagacctcgattccgtgcttttgtttcattgtgatagcatatagagctctagttgagtggtgaactcattgagttgtgttgtgagctctcgttgcaacttgtgtgcgtggtgttgctgtgatttcttgtcttgagtgtgttgctaatccctcccttgctccgtgcttctttgtgaactttaagtgtaagggcgagaggctccaagttgtggagattcctcgcaaacgggattgagaaaaagcaagcaaaacaccgtggtattcaagtgggtctttggaccgcttgagaggggttgattgcaaccctcgtccgttgggacgccacaacgtggagtaggcaagcgttggtcttggccgaaccacgggataactaccgtgccatctctgtgttgaattctttgtggttatcgtattgtgcaagaccttctctctagccacttggcaattattgtgctaacacttaaccaaagttttgtggcttaagttttcaagtttcacaggatcacctattcacccccccccctctaggtgctctcaattggtatcagagccgttctcttcaagaagggactaatcgcccgaagag

SEQ ID NO: 12761 - DNA, 1500 bp, Zea mays
tcggtccacgtagaagtcgtactccacaactccaccaacatttggtagtactcaaggtcctgccattcgtattttgaaatttggttttagcagaaactcaaataatccatagtatttatacaaaaattggcatcatcccgtgaacgtggtccgatgctcctcatgtccgcctctaaaattaatatgcattttgatagacatatacatatcctgctatatacacatgtaaatttgcttgagttagtgttacaagtcattatctagcgaggacaaaatcttttgtcttcaaatcattatagggcacccgaagggcacctaatgttttagtgatctattattacaagtatcgatagctcatattgcatgtagcggtgataatttgataacatttccggtgaaaatgagaaaaaaatcccctaaaccctagctcttacttgaacaccggctaatcaatcctatacatcggtttatcggctttggggagcggctaaccgctaatactagccgatatatcggttttttcttttttgtatttttttcaaaacttccataatttttagtttgaaatctgttgtctattttgaaatttggttttagcggaaagtttgcaaataatccatagtatttatataaaaattggcatcaaaartttccaaattttatatttttttaaattcaaaatccaaaatcggtgtattggccttaccggccgggtgcagataaccggctagctgtccggttaaccggattaccgaccggtttgtggacccttgcttatggtcgtatagagaacacgtatctagattagtaattttaatggcctcgttggatggatttggacatcatgtgggtatgattactcgcacgccctccacgtgatagtggctgctcaactcgactagatagcgatgcataatgcaggttactctatatcactatttatagtttagttattaaaattccttactctatattaaaattctcctcacccatatccctctatatattcccttattatcaactactacatatctgttcactctaatctaactactatattttttccctctatataatagatgattttggtactgtcaacaagtagtgcggaatgaaatggcacgcaccatatttggcggattcctgttgctccggagctatgcagtgcactatggcgtacagcgctgcagcattctcttccagtcttcctgtactgtacgtgtttttgttggaagttaagccgaagcccagtgcagatagctttacaacgaagtaattccagatttgtagtggacattaactaattccgtctcgctgattcttttaaaagaaagaaataataataacgtaggcagttatgtcggcggagcgatggccgcctgccatccggacgcctctgcagcccacaccgctatattacgcagcttcccagatagagactgatacacgctcagtcgcttacggctcacccaagaccaagaaccccgggcggacgaaaag

SEQ ID NO: 12762 - DNA, 752 bp, Zea mays
ccacccgctgtgtccaaaaagacaggatcgatgaggatcgaacgattggacggcgatagccgtgggcggccgtggcggaaaggcggcgccgcgccggataaagcgacatgcgattgtgtcgcgggccttgtgtgtggtcgcatgcatgcgccgcacatgcgcgcgtggcgacgggtcggcgtcgtcgtagcagtctagcgtagcagtgcggcgtggtggtggactggacgactggtggtggtggtgcgcatcaactttcgtcaccggcgcggccagatttatacctgacgtcgcagtttggagaatcagaagcaccaccggtcaaaagggggcggcgtacaaaacacatgcgtacgacaaggtaaatagcacccataagcgcactggaaagcagtgagtaaactgagaaagaaacgtggctagttataaatatacaaacatagaatatatacattctgattcagtgtttcattcacactgaccctctgatcaaggtggctgtacatgccccatgtatatcacaccagtacggtacatattgctagcatatttttcttcgtcattttttttgctttcctaattaactactacagtgctatactgctacgtttccatacctatgaaaacagagaacgaagactgaagtacgtagatggcgactggcctaagacttaggacgcgatgagaattgctggggagattagataggaagccagagcggcttctcatgttccagataaccccagcaaccc

SEQ ID NO: 12763 - DNA, 539 bp, Zea mays
catctgttttgaatacctgttttgaataccctgctaattgtaagaaaggactgttcagcttaggatttgtttctgagggatgaccccctcagatacaaatatactaagttgtacagttcttttttacaattagtagtaaacgaacagggtattcgagaattggcttggaatctactacgatacaaaggaacgcaataaagaagagcatagcatccaactattgcatttcaagcacagcaaagcatatgtattcgaaatttcttttgcatcaagtgacagcattccacaaggttggccaagctaaagaccacataccttcatgtctgcactgtgaaattttataattgaaaagggaaacagttttttttcctgcaatggacagtatagctaaatccttatgcctcttctcgacacagaagttcggcttttcgtatgtataacctgaaccaaaagttctccaaaaaaaatatgtatacccatatccaagccgaggtaaaaaaaaaccagcttcagcatggaaaagaccccgtcatcttgat

SEQ ID NO: 12764 - DNA, 1500 bp, Zea mays
gtgaacagctaactccacgtaactgagcactgagcaaaaaacaatttatgtgtactaggacagaatcacagaacaatttaagaataaaaatgcaattacctattgagcattacatgtaactgtctaactgagcactgagcagtgtactaaactaataactaaagcaatagcaactacaagacaacacatctaaaytaattacctggcttgggggcgacggcggcgtggcgctgaatgcctgaacctgtgaaccgctgcacgtagaaaggagaagctgtgacgccgagcactcgagcagggtcggccgaccaggtcccagggcgccgctgccgcaacctggccacctgctgccgctgccgcaacctggggctggctgggggctccgtagtactgctgccgccggccgccgtagacccgcagtgccgaactgctaatggattaggttaggtttaggcagtgacgaactggttgctggcggctgctgccttctcgctggtggacgtttggacgaacgagctagctagtgtcgtggtggactggtgggccgttggcggtggacaaggggcaagggcctgtaggctgtagctagcgtgggccattctgccaatgtttaatgggctttgcatccgggaaaatataggaaattcctggtataatacgggataccgtaaatacgggcgggaaacactctcaaccgttttcggacccgttcccggacatacctatcccggttcccgtaccgttttcttattttcccgaaaaaacgaaaacgaacggttcaaaacgggaatacggtatgggatgggacggtattttttctgatcgttttcatccctacatacatgcataagttgaatatattcacggtgtgattcttattattggttgtcgtgcaatcattaatgtaatgcatggaaaatgcagaaccaaggcactcatgaacgttccagtaaacatttctaaatcacgaaaaccatggcggctctttatcataagaaaaaaatgttccccaaagaggaaagaaaaccatgattttgaaagaagtataggcccatcgctcgcctcaatctgatgcgatgggcggcccgcggcccactgaaagccccttttcagtttttagcacacgcttacataatacataatacgcagaaacttcagggactcgcatcgaaaattgaaaaccctataatcctccccaaaggcccaaacctatcgcccgtacgagactgcgccgccgttgccgtctcctcctccgtcccatcactctctgctcgcgcactctcacctgcccgcgccgtcttcgaccgccaccaaggtcagtcatttcttccgctccccaatctgacgtcaccgtaccaaatcggagcgcgccgccccggttgctgggtgcgctagaatcgattcgttctgacgatagatctgtgctccatgtgccgtttgaccgactggttggttccgttccgttctgttccgcagatgaacaaggagaggctcatgaag

SEQ ID NO: 12765 - DNA, 1500 bp, Zea mays
ttccgggtgggtagacggtgttgtacgggagactgcgcgcggccgcgacgacggatcaaaaaaataaaaacaaaaacaaacgaatcttccgtcccctcgatccgacaaagtgcgtgggcgccgcggcgtggcgtagttggcgcccccgcgcgcgcgcgcgcatagcctgccttgccatgccacagtcgctttccccccctcccttatcagttatcacccagccaaaagcgaggccagggaggggtggtggggactcggtcttgttcgtttccgccgtcgggtttattcgccgggaccgcggttccattgctctctgcttctctagacaccggcggccgtcgccgtcctcgccagccagtcctactcctaccactcgcccgctcgtccgcgagcgagctgatgggttgcgtcggtcggctcggctgattgggttccgtcttccgtcctctcaatcattcggttccgcgacctggggtcctaagacctaagcgtcgcgtccgtccaaggccacggagagtcctggtggccgtgcgggcactgtgcgcccgtggaggtgtcgtgtctcggtgcccacacgacaacgacgctcctctgcacccccgtctctacaagtaccacctggctgactccagtttcccgacgccattccacgtatctcttgtttaggccgggctcgagagagttgggctccgaatcctgggtgggtttggagttggagaatcgccttcgtcgctcgacccagaaagattcggtaccgcatcctcttttcccataccgaccttcaggaatctactttttcttcttcttttgtgtgtttgtgcgctttcgggataacagacgatgcctgaggaatctactttgttgttcttgtgccttcgggataacagatgccttcagccatcttgatcctgcctgcctgcgcgtgcctatctggtgatggtatacgaatctgtttatgaggttttacttgccttggcctttgttccattggtttgcttcgatcggggagactgtaatgtagctttgtccgagggcataaataatctgtgtggatattcggttcctgtccatttttaagggcgctgcttgaatcttgtatccgtttttttcatgcacttgtctgcactcagagatggtggaaataggaagggaaggaaaagacaaatggattttttttacttgtctgctgttctgctatcttctgaactccctcacttgaatactcttcttttttttagttttgttcctttagtgacacacatattgctcgcctgatcttcattcccacactagctttgggaggaactggaacgcgtataacaagtttttctagactctatgtcatttcagctgtgcatctacatcatctttgttgttgtgtattgattcccacgctagctttttgcaggaattggaacgcgtgtaacaagttgttattccattgtgcatctacataatctttgtagtcgtgtactgactgtcccagtatcctattttcag

SEQ ID NO: 12766 - DNA, 1500 bp, Zea mays
agttttttttctggttccagcagtacttcaatcttgatcgaagtagtctctactaccctcatgtcaacagagaacagaaccgtgtgtctacttatagggtcctggagtcagaaatatgaccgactttctatccagtttaacgctaagttcttttccttttgctattaaaaaactcattatactttggtgtaaaatgaatgctccggataactatgcctatttagttgtactcactgattgtgcacgctggcgccttgcatagtcgtgcatcttggtagttcgctagagaacgactctctcggtatttgggtgtacgtatatatggaatttatatatctttatggcatgtgtaccctcactggtactggtggtggttggttctaggcagggccgttcctgacttttcagaggcccagtgcgaaatccgatatcaaggtccatccacacataatatatatatatatatatataattatacatatattatcaaatatttgacatataaaaattattatgcactattttaaagtttacaagataacaaatgtaaaatatagcaaaaaacacttgttatctgatattattaaaaatatcttttaacattttatgatacaaagtcatctcttatatcattgagatcaatctcatccaacaacttttttcgatatatagaatcaccaagctatttaacatctcttaagttattgttgataaaaaatagtttacaaaaatatttcaattttaaaaagcttctctctgccaaagcaaccatcatatgtatagtttataatactctccctatatcaaaatagaatttgttttgcttatttagtggattcatcatcatcaatataaacataaaaatcaagaactaaaacaaatactattttacaacgaatggagtattcgataatcgataactaattgagacagtttaagaatataaacgagactactcgataacgcatcgctccttacgtatttgtgtctataatagataggtttaataggaaaaaatgctaccgtacagtggctagggggccctctatttttgggggcccggtgcggccgcacccttggcaccacagctcggataagcttgtcttattgggcccgccgttcagttatgacagcctgccacgtgggtccacgcctatcccaagcccgtccgatcaacgaaccagaccgcggctgcgcctgggccctacaccgcggcaggccccggccgtttctctagcctctcctccacccaccggccaccgggcacgtgccgccacccgccacagcacaaggtcggtccacagcccccctcctccagctcgaaggtttggatcgaagccccacggcaacagcatttcaaatccgtcctagtactcccgcaaagcccgcacagcaccagccacccgtccttttccctttctttccccccgcctgcgtccgacgcccgagtcccgaccggccggccccgtcgaggcagcagcacacagccagcgggcagcc

SEQ ID NO: 12767 - DNA, 1436 bp, Zea mays
ctgcagaggttgcacatctttacccataagtcgtgttacctatttgtcacggtttagctagaccctacacctcttccaaggaggtagagcaaggttcactgcgatgcctttataaaattccactcgtatgagaaaacccactccagatttaagcagagatggtatagaactatagataatcccgaggtctgaaaaaccattgtaacatggtcaaccccatcactatatttgagtaactcctccccgcttgccctttcgtgtaagattcttacacactagcttccctgattaattagccaagacatgaggctatatagtctctgtggttttctcggattggcactccatattccaattaaacgagtgattttatcatgcataatatgtatactagcaacaataaatcatgctcagtgtatcatttatcccataatcaagtagagcaatagcaaatctatccagtaataaatataccaggtataaacaaggtatagggaaaacatatataggtaacacattagttctcatcagattaattaaccgcaagaacaagggggttgaatgcactagagctattcctcccgctcccggtgttccattactcctgtacttggtcggcggattgtgcacgaacccaatcactttggccagtgcgctcatgtaaagatcgatcgctccaggactaggataccagctttctggtggtgtaatacgtgcgtcttcgtcgtccttggcctgctcctagcagtagcagtctctcgagaaaatctgtgcccataccaaacgtcagtggcagcgtacaggtgcaagtatacgccggttttgtcaaacggacgagctggcgtggcctctgctttcttggtcacggctcacgggcctgcctgcgaccttgatgagccactacgaggacgacaaatccgctgcgtgctgagataataagacgagtttatggtggcactggcacatgcgctggatcgcggagctgtagaatcgccaatgcggagagcttaaacaatctcgccagccgaatctcgtcgatcagatcagatggcagacaaaataaggatcacggagtgtgcagagatatccaatccaagcacatcggaggtgctcattgaagagagaagatccttgggtccggaaaaggagacgagatcctgtcctgggcagcgccaggaggggaggagttaatacctgcgtcccctggcacgtgtgggtcgccccgtatgaaaaagctcactggccggaccatccccgtaccgagatctcgcggattcactcgccgcactggggatctcctgaccgatcgcttcctttcccccttccgtaacaggcaagaagcgcgccccccgcgcgtgtatataagcgcgcagcaccggcccaaggctgggcaagacggcgggtcgtcggagtcgacaggggagtccaagcttcag

SEQ ID NO: 12768 - DNA, 345 bp, Zea mays
tgggcgtctggtcacaggggtcggagtgtgcgattggtaggattgaacgcgatgcgggccagcctttttgggctcggtgggccgtgggcccccatttttgtttgggcagcaagggaaatgaatttgatcctgctcatcgatcttattcatttggcctcaacgatcaggattagtttggcttccactccttgagccttctgctcaaagcaaccaccgctggctcagctcactccggtggcctccggccgcctctgcctccgaggattcgcttggggggagacgtattatgaggttcgcggggtggtacctgaagattgcggcggtggggcctccattggcgctgcc

SEQ ID NO: 12769 - DNA, 608 bp, Zea mays
tgaagacgatggagtgacgccggctccgtactccgttgtgttacgggtctatgactgtggcgtggatagagatgtccaaacgggtcgtccggcccggacccggtaaagcttggtccattttgggcccggcccgccagacacgattagaaaatcgggccgagccggctaagcacgtgggctcaattttttgtccgaacccggtctgcaacgccgcgtggatgacctatatactctatcgtagtctctcctctacatatttgactcatctagtgaagtactattgctagccgccttgttggccatagcccacagtcccgctcccacacacgcaaaaggtcatcgtgcgctgtgtgctttgggctcgatctggccgcggcggccaccgtccgttatatatacacgcctccgcctcccatgcatggacacccttgtcctcaggccgcggccataaccaacacaccacctctgctgatctcttgttcttgtacggcgccggcgtggtggctagctagcagctgtaacttccaccaccagtactcagtactcacatcaaacacacacgaaccatcaataacccctctgcaggctgagggaaacgtgaacacacc

SEQ ID NO: 12770 - DNA, 988 bp, Zea mays
accagccatgtctagtgtccactattggcactacccagaacaagatttaaaaaaataaccaaagtaactaatccactcgaaagctatcatgtaatgtttaaagaaacatctattaaaaccacgatcctcttaaaaaacaagcatatttcgaaagagacaaattatgttacagtttacaaacatctaagagcgacaaattatatcgaaaggtaagctatgacgttcagatttttctttttcattcttgttattttgttattgtttttatatacattttcttctcttacaatagagtgattttcttccgattttataaaatgactataaagtcatttttatataagagcacgcatgtcgtagattctcgttcaaaaatctttctgatttttttaagagctagtttggcaaccctgtttctttcaaagaattttgattttttcaaaaaaaattagtttattttctctttataaaatagaaaacacttagaaaaatagagttgccagactagccctagaatgttttcccaataaattacaatcactgtgtataattatttggccagccccataaattatttaaaccgaaactgaaatcgagcgaaaccaaatctgagctatttctctagattagtaaaaagggagagagagaggaagaaatcagttttaagtcattgtccctgagatgtgcggtttggcaacgatagccaccgtaatcatagctcataggtgcctacgtcaggttcggcagctctcgtgtcatctcacatggcatactacatgcttgttcaaccgttcgtcttgttccatcgtccaagccttgcctattctgaaccaagaggatacctactcccaaacaatccatcttactcatgcaacttccatgcaaacacgcacatatgtttcctgaaccaatccattaaagatcacaacagctagcgttctcccgctagcttccctctctcctctgccgatctttttcgtccaccagc

SEQ ID NO: 12771 - DNA, 1500 bp, Zea mays
tattagagaggtggagtttcagacaagaaaggggaacttgataaagctaataaaatagataagtgggacaagctttgaacttaactagactttaacttatttatctaatgatgcatttgtggccatcacttcacaaaacatcacaatcattacaatggctcaaatcaaacatttgttaactcaaaagcattacattgcacgtcctcacaagtcacaagaacggttctagtcgaaacatccgattaagataaccaatcctaagagcctggtctagaagactggtgatggaacaaagtgatccataaaggagcttcttacaaagtggtgatatggcagggccagggcaggaaacatcatccgtaaccttccgtggatcctgtccagcgagctgagcctctagctgagcaacctggcatgagcatcctgtagctctccatgggtctttgctagctctgaggtggcgccgtcgaggtcggtgttgagggcagcaactactcgggtgagagtgttgatgcgatcctctctagcttctcccaataagatggcactgtttgtaatttttgttgcctcattgggacagcagctagcactgttggtgcaaaatccttgattgagcaacccaataactacttgtcacaccaaaataaagtagaatgccattgctgaccattgattccatagctatattgaacaaagccagggctttagaattagttgggatttcaagacctgtccatggccgattatggtcagtttctggagccataaccagcaaatctgcagcgcccaactcataacttcaaccgctgttcatatcatcctatccaataaaaacacaatccttaacttcggttgcatggttatggtcttatcattaacgcgttatgcattctctccttttggcttgtgcttttggtgaagatccattttttattgtaaaactgatgtatccctttaaacatatcactctgctaactgctagtgttgttttttggtgtccaaccagatatttcaaatactgaagttatggtttgctaaccaaaaactgatacatggtagtgggagaaaatgcattaaaaacaactcagcagtactagcttgtatgccacatttggcttgtgcttttggtgaagatccattttttattgtaaaactgatgtatccctttaaacatatcactctgctaactgcttatcagatatttcaaatactgaagttatggtttgctaaccaaaaactgatacatggctgagttgaagagaaattctgttgttactattatattgctcatttttcttatgtttgtctgccaaaaaaaatgcataccattaatgaggtagtaagatttctatgcagcttacacttaattagacccataatctttttatcatcaagacctgtgcacttttgggtttcatttttgactgttacaactcttgggtcttcaccaatgatctttagtgccaaagttatgtgcatctatgttctccaatctccaag

SEQ ID NO: 12772 - DNA, 61 bp, Zea mays
tatctagcagcaagcacacaccgtaacatcaaagccaacgacgacgcggggccggccgccc

SEQ ID NO: 12773 - DNA, 99 bp, Zea mays
cgacgtagctttgttgcattaattagcacagcagaggtgccttccatctgaccatcctctcttgcaaacaccgtaacaccgcgtagtagagtagagatt

SEQ ID NO: 12774 - DNA, 798 bp, Zea mays
tgttgtgcattgttgattgctgtgggatattgtatctggcacgttttaaagttccatttttgggaattttgcaaatcgatgagaatcaggattgctcgatagttaatactgcacaggcgatgaaagctatcaaaaacttaagggtgggaggtcagcagatagttgactcctgtactctttctgattgcattggacttttttttctgggcctatcagggtcctattcatatatgttgcagttacctgttttctataagaatctattgttatttatgcttcccaaccaattgccgtgctaaatgactgcaactattagttagtcatgcaaggatgatataaaccctttatctagatttggtttaggaattaggatcccctcttgtggcttgcatcaatcctgggtcccatctctattgtcagcaccatttttagccaaaatgacaatatcccagtttcggttattgtttttcttatttatctttgtcattttatttattcattgtaatttctttgttccatatcaacagacactccgtatcggagattcttatttcttattttttttgcagtaatatgaggtttgacatgacctctttccttgcatattgcacatagaacctacttatgttgcaacctgaaatgcttgctagtcttattaattcatcaaattcgtgtgtgatgcaaatgcactgagctgtaatgttgtatatatctgagtggaagttgagcgtgcgcactgcttatgtgaataacttatgacttgcctagattgatttctgtagaaatgttctatacctt

SEQ ID NO: 12775 - DNA, 666 bp, Zea mays
ggtaagttcccagatgccaagctgtgaggctggttttagggttatatttatcgcgacagccacatcgttgtcattttaaattttctcaaatatgtgggccccagactcctcccgtgcgacgactgggcccaccccaatgatgagcccgaaacggcaacgccgagagctccgggagagaagagaacacgcgcggcacgggcgcaccgcgcaccccgaccccgcacaccgacgacgaagagaggagaggaggcggagctcgagcccaaccgcgcaactcacttccccgtcgcgatttgcattgccctcctcttggcccccgatctcgccgtgccctacccccagcctcgctccgccgccaccagagagatagcgccccccattcccacaatctaatccttccgtccctcgaggtaaacatccgcccacggcccactcgcccgcccaacccggttctccctccaccctccagcaacctcgcgcctcagcgacccgccgaccccatcgcttggcttcgctttgggactgggggttagttgattggtcggttgattgatcgatctagtgctcgatcctcgcaggagccgagccctccgcgcggccgtgggatggggcggtgacaacaccggtgagtggcgtggggcagggagccggtggcgagggcatatc

SEQ ID NO: 12776 - DNA, 798 bp, Zea mays; identical to SEQ ID NO: 12774

SEQ ID NO: 12777 - DNA, 666 bp, Zea mays; identical to SEQ ID NO: 12775

SEQ ID NO: 12778 - DNA, 309 bp, Zea mays
ttgctggcggtggcggcggcggcggcgcggtgagtgatgaccacgtgagactagttgggttcagtattcacagtccagggtttgatcaaatcaacacgcaaattggaaggcaccgtaaccgttcgattacggggcccgccgcgccactcgacatctcaacccacactggcccactcctgtcttgaacatctcccgtccccatcgtcctcgtcgcatccagcactctgcactcatgcgtttcctcccctcctaagccaaaccccgaatcctccgtcgcccagcagccgccggtgacggcgacgctgggca

SEQ ID NO: 12779 - DNA, 145 bp, Zea mays
ggtacgtgtacgtggctgtgcttatgataagatcgatcaataacatgtggagtatacgtcctatggaatggacatggacgtggaaaccgggtgatatatatagctagttttggaactcgcgtgaaccctcacaggaacaggtgac

SEQ ID NO: 12780 - DNA, 1500 bp, Zea mays
acctcatctcaccacaggaaccagaatttcccactacatcctgaaatacagagattcaaatttgctgatcaatagcttaaatagcccatgatcactaggcgcaactggagcgcttcttatacactatatagaagcattttatgctagtttagatagaatatatgattgtctagtagatggttgggcttatattttggcatattggcacatgtggcatttatgctaatttatatttgtatatgttgatttttatacaccactctaatgctgacttttaggtgtatgtatgcttaaattaacatgtgtataacgttccattctcgtcgtgtaaaaaaatagttcgaaatagtgcagtctttatgagatcgtaactgaacgtgaacctttgcttatcaagttgcagtggtatccatgacatccatgttcgcgtggtatttacgacaatcacctgtattcgtgcgcatcaattatgttgggttcacatgattgctggcatagtgtccatcttaagccatccctccgttataactaccatttttaagctcaaaattaaggattttatgatcatcgtgatttatgtattttcaaacaaaatttacgatagtttttattgtgttttacgcttgcactaataggtacagttgagtgcttgacacgttagtgttttgtagtaatatcgggtcatgcaaccggaactaaagattgacaccttttatcctgaatatccagttacgattgagaattcagtacaacggacgattccgaccgataaagatgaccctttttccaatagttccatttaagaatttgagatatcactttatgtctatgtcatgacaataaaatcaatttgaaatataaatgcaagatgtttaatgtcatgcaattacgcttccatgacattaaaccgcatgcaattaagctaccatgtcatacactctatgatatgaatgcaagatgcttatgtcatgcattctatgatatgaatgcaaggtgcttaatgccaggcaattcactgcatatagcaagcttaacgcttggtgtgctacacacctctcggtcccacgccgcaggctctcgctgctctgtatgcagctcggcacaaaataaatgacgcagctgcaatgctcttgtgtctttcgtcacccaaaataataaagttctacccaaaaccgatgcgcacgtctttgccgtctccatcccaacaaaatccattggcaagactccatttcagcggtccgccccgccacccccagcgacgttggcagccgtccgtgcgaaaccgcgtaccaccagcccgcttcgtttgtctcgtcctcggcccgtgtcctacctgccgcccggcccgctacactctctctctctctcttatatacacacacgcgcgcgtgcgccatagccatctccaccagagacctcgaccggctcttgatcaatcatctgcaaacatagttgttgagcccagatttcaggcagatatatatagctagctacctagcc

SEQ ID NO: 12781 - DNA, 398 bp, Zea mays
accatgatctatgctgtttcaatgcctcctaatctgtgtacgtctataaatgtctaatgcagtcactggttgtaatcttgtttgtgtttggcaaattggcataataatggacagattcaatgggcattggtgctgtagtcgcatcacactaattgaatgggatcatgttgagctctcactttgctacaatttgctccagcttgtacggttgtaccctcttgctcgtctatagtaagggccatctaaaaaaaactcaaattagatctgcaatacaagtatgattgggccgaatttggattgtcacgggtccgcgaccgcgaattgggctcggtttgatttagccgacatagtagtgaccgacccgagccggcggcgagccaaaccgagcggacgccgcc

SEQ ID NO: 12782 - DNA, 1355 bp, Zea mays
ggtaagttttcatcataaacagatcaggattaacaccattcaatcttcaggtaagttgacgattcttcgctcatagatagattgggattataacagcataaaatcttcaatcaagcaagtaaagcgacattgttatgtttaagcagtaacaacaaaacaaccaaatttgagtttacaatataactacaaagaatatctatttctgcattctgcaatgcactagtacagagtcataaagctgctgcaaatgtttaagactgaatgtgcctcaaaagtagtagcgttgttgaattgacataatcactatacctggagttgagggtagtcgtccttggaaagcaactgtactaagcaaggaagaactccacatttaataacctccttagggcttgttcggttatttctatcctatatggattggatgggattggaaaaaattatgaaagattttgacttgtttaggattgaaactcatccaatcccatccaatctacatggattgagagcaaaacgaacatgctcttaattgggagatcctgctatgataaatagatccattgttaatgaacaagaaaaaacaatgtatattttggttgcagtttggacaaccgcaccacacagtaatgatcttgaatgcagactcggtagaggattagacgaaacgattctgtacaattctaaaaagttcaatagaattcctaaaaatgaattatatttgttgggactatgcttcgtcgctgaaggtctggtaggaagaaacagcttcggctgaagctgtccgcatgtaatgaccgaaggttcctcttcatgaagcttcggaattacaaaccgacataaaagtagaatgaccttttagtccataaatgtttgagtcgctgttgtaaacccttatgaggggcatgattgtaattcctcacaggctgtgtcctgtgcctataaatagtgaacagtattcctttactgttcacggattcctgtaatagtgatcgcaccattcgggaatcaaccttttgccaaggcagaggtattactgtattcaatgcttaaatattttagatagatataataaaaaagtaatgttgttcgtttataatttattcacctttgacgcttcatattttatattactttattcaatctgttagaattcaattacgaagatttaaccttcgtaatcatattgtctttaaccttcgtccaaagttcattaatccttaagggaataatgcttcgttggacgaagggcattaacatttaacattttgtgttgccttgttcttgattcatagcatttgagaacaagtccccaacattggcgcccacctccggtcaactcacttccactttttgagctg

SEQ ID NO: 12783 - DNA, 1236 bp, Zea mays
tcgtcttcgtgcaagaaccccccctcctgcttgcctgccggtaattaaaacctggggtttcagaattctgtcggccatgtctggaaaaacctttgttgtagaaaagatggatggggtcactttcgatctcgttcagaaagctctcgtgtcatgctgtccgtgctactcttttttttttgttaaaaaaatggatttttgtacgcttctgcgctctgatctcgccgccttcggtttcccctgaaaccggggcaggctatacatgcttcttctttttatatatatatacatatatttactattactagttattaggcattattctagaaagcgaatcatgttgctcttggtacttggtaatagttaaaatattgtaaaccttaagagctatacatggccagcaggcactgtatgatccaaattccacggcccaaacaatctacaaacaacggcggtaaaccttgagagctagcagaacagaaacacgttcggctggaatacagcagtagctactgaagctgtaatttataaagataaaatattgtataagtgacagccgtagttgaaaagccgcagcaaggtgcagcgaacgatatccgatatcctgtagcaagggaaagggagacgcagggcagcagttattctcgggccaactaccctcaccctcctcctcttcctccctctgcccgcgtggtgaggtgacgcgtcatgtagcacctctctctccgtgagaaaggccgattcttcacgcgctcagcgcacacacaaattaagcttaatccttggaagtctctctctctctctcgctaaacatgggcttaagaagttccagttcagcagcggcgctcggttggttagcgtggggcccgggcccccgccaacacttctcctccatccgcacacaacctctcttcgccatggcacccttgccctcggcataccgcatatatagggaaggaagaggcctctcttctccctcccatcgccagggcgtcggagcgagctcattctcaactcgactcaagagctctgcctcctccatcttcccttctctgtaatctctctctctctctctatctctctctctccctctctctgtacgaatagctgtagctcaaattgatcctcttgcttggggctttatatgctacaaccaatggagcaactgaagtgaaccaaagacgagctaacctttccagttctggacgttcagggcctccggagccacgctgatcagag

SEQ ID NO: 12784 - DNA, 1500 bp, Zea mays
gatggaaatcgatgcaaggaaaaaaaaagaaatttgagggccgggagaaattactgggaaggaaaggaataatgagatatattactatctgggtggccctgcatgcctttgggaggaagctactgatcgatggagattggagagccactaatgaagcgttgccaaaaccataccggcatcataaataaataaataaataaattgaaaagaggcgtaaaaacagagggcgcgttgcgatgcgacagacccttggtctcgggtggtgccgttgcagttttggaacctatcccgtccgattagttttgacgcgtactccctcaagttagcagtaaacccagtccctcaagcgactacccaacccaacccaacccaactccaccccaccgctggtctggtcaccacgcattgcattgcgttgcatgcgtgcgctttgctttgttttgtttgcttcccgggagggagccttctgagcatcccagccttgctgttgtttggcaccttctgctctgaactcttcttcagtctctctcctcactcagctcgcctgcacgtatggcgcaccagcagtccagcaggggttggagtggagccagtcaagcaaacgccggaaaccggccaaccgcacttcccagtcgtgatccgagaggagaggagaggaatggtggcttaacatggaaaaatctggcctatattaagctagcccagaaaaagagcaaattgacagccatcgccatggagtggagatacatcttcaaaaaaccaaaaaaaaacttactggtgttactgctcataatccttgcatttgacagtagtaaactttgcatagctggttgataataataataataataatcaaatactatatgacacagctggttcataaagtagtgtagtacgtgtacaaatgatctgtacatatggttgaaattaaatacttaactgttgaccaaaactgatccgtgtgccatgcatgcatacaagacaaggaattggaccacaagatgcatttcatatccttcgtatgaccaacattattaattcatacaatgtactcacctttttatattttcctttagatatctttttcttaattcttccttcccttttttttccgggtaagatacttgggcctgtgtgtcactccatatctttctctcttattttaattgacatgccactaaatttctcttgtccatcatctggaaattaatgtttccggtattcaaaagatataatagttgtgctctcaaaattgcaataaccaaaggatacgaggagcccccacaaaaaaaaagaaagagaaaagatatgggaggagatcaaaagggaataaatgtggggggaagcttggcagttccgctataatctactactaccgcccccatggaggccggggggcagttttctctctcgctcgctctcgtctcgtctcctccaaaagctcgtatttttagctctccctagctctctctctctctctctcacgaccaagctctcgcc

SEQ ID NO: 12785 - DNA, 1500 bp, Zea mays
aacacctttatgctgtgaataggcttgttcggtgccaaaacttaccgtatattttctgacacacttacctaaggccctgcgtttaaattctttaccacatctcgacatgtataagacactactgtctcacttttataagaaaaaaccacatctcgacatgctcccatctcgatgccccgggtcatttgagaccctccgccgtttatctgcccgtgggtcgcagcagctcgcccgtcgccctcaccggccaccgcccaagcatttcacggccctttttggcgctctttagattcgcgagcctccctcgcttgcttgcggtggatcggcgccggaaaagcaggccttgacaggcagcgagaggtcagcttcggcatgaacctttttgctgatggagacgccggaccaaatcgtcaccaacgatttcgttagttttttttttagggaccgttcgcccattttatgcggctgcactgggtggccttgtcccagttcagctgcgctgcagtgcgttccatgtcacacactttgtttcgtcagtcacgcgtttggatagctgtttcttttggagagtttgaaaactcaaatcttttccatgattacatgactggagagggttgagagagaaataatgtctctctcgttccctttcaatccaaaagatggtttgagtttccaaactagccctcaatatccaatgaatcggtcaataattaaaactaatagttagctagctggctaaaaattgtctagttaaccagtagttaggcgaactattagctgattttagttggctgaactgttagctagctgggttgttttgatgtctacaactaaaacagggcctaagtatcttcatacaagatgaccatacgcatgttaccaaaaaagacgaggtcatgattcacataaagataatgtagcaaaggattacaattccagcgaactcgcttcacaggtaaagatgtgcaggagcaatcatcctttctttctttacaagatgatgaaagctgagaccaaaagacagtcaagctatactagtcagttcatcttaattagacagcaaaaggagcagaccagggccgaagccagccaaatcttcgatctggtctcgacctcacaattcgctcgctaaaagaagcgccgccctctatatgttaaactaagcaaccgttgccctaggctaggccgcagcagcagccaggaccggctatacaacggcgacagcctgggttatgccggcctccatggcaggtggatgggtcacggtggattcagtggcagctggcggtgacggtggctcgggccagcagaactcgaagggggcttcgaatgggggcagtggagaaggcgccgcgatctcggcggggcggggttccgtgtagtggaactcgatctggaggcggtggtgcaggggcgttgatgccatgagacctttcttgatgtcagcctgcagctcccggatcgggatggcggctaagaagctcttgatgtactccttgc

SEQ ID NO: 12786 - DNA, 1293 bp, Zea mays
cccgggatcctgtaagtcgacctgcagtacctataagcttaacatgtaatgtgtgcacctttaggtaataagcacgttttctgaagttaggtatatattttatataggtttgcagacttcagttatgcttgttttagatttaagttttatttagctgattcctaaaggcgcacctttacgtaaaaaaaaacattgttttctgaataaagtaatttattttatataggtttgcagacttcagctatgcttggattagatttaagttttatttagctaatgattcctatggaagcgaccatcttgacacgatgtgtataggtttcagttgatgaatgggagctcactactgaatgtttgaatcacagttttgttccccgtgtttaacatgtccactctgtttttgtgctgagatgagtttacattgttgaccacatgaaagaatttcttttttcacttaggaaatacagttggttgttacatagcaaacaccaaacaggttctcaacgtggcccttatattttgtttttaatgtaggtattatgacgacttcacatcaagcactatcttgaatcctgaatgttcctgaaatgctttgttgaggggagtacagaccaatgtttcttgttagtagaaacaaaatgactaccggagatgatctattatttctgtagtttccaataaatatccttgaaatctggaatcacttcaggatttgtatctatatctgctggatatcatcagttggtccttttgtattggaaagtaaaaccaggttttgaaccctgggataggccataggcacacataagacaagagcattgccaccttgaccacctgagtcctcattcagtttatcattgtgagaccatgataaagttttacgctctgtttggatgttgtagttttaaggaactgtagcattagcaaactttagttttagaacaatgatgtgcaaaaaccatggtttagaaaaaaaaggaggtctacagtggagtttctaaaacttcaaaaagactagagttttagcaataccatggttttcaaattacaaagacctttccatccaaacaccattatagttttcaaacccaaagtattccataacacaaaggcatttttctaaaacaacaaaaaatgctttgcatccaaacaggaccttagctttttggttgctatgatattttgctgaaattgcagaccttttttcgctcttctcatatggatcacttttcttctgaattaattttgtttcattaattttatttgttttaggacacgagcaagaagtcacca

SEQ ID NO: 12787 - DNA, 489 bp, Zea mays
agagtgtatactcttgcagtggcagcaccgcagcagggtggttccgcctgcagaaggtgtcaaacatacggccatgcatgcatgtgcccatgtccatgcgtcgtcaagagttcttctgttgtcctctattcaggaaacggaaacgtggtagttggcgccgacgatgatgtgcacggcatgtcaactatagtgccgaacgagtgagtctccacgtactcatcatcgatctattgcggcattgcctattctccaacgcacacggcgcaccctcacctactcccgtgcgcgcgcgcgcgcccggggcggggccgctgcctatatttatagcgcgcgcgcatagccgggcaacacaagtactcctaaagaacaaaagctgcagcgcgatcgagcagccagaggccagagccagtttcacttcactatcactcaccagaggtacggtgggttttagtggtccaccggccgatcgatcataccataccataccat

SEQ ID NO: 12788 - DNA, 759 bp, Zea mays
tttagtctatgtttatacttatatttgacattcaaacatttgatatgatacatatcccttaatcgatccatgcgtgctaagtaataagtcgaccttcctttgtttaagggttgtttggtttgaaggggttaaaatacatcggatatttgactattagttagagtgagagtgtttgaatgcactggatctaactaatagtttaactattagctatttttagcaatataactaataattagctagataagtccactaaaaatattttagctaactaactattagctatattgcatttaaatatttgtatagtctaattacaaaactaattataagtaatagtcatcgaaacattcaatataatataatatagactaaactttaacgtgtataaccaaacacccctaattgcagccgcaattattgaaatgaaaccgtaggatactggaacgttctggacaggattgacactcgtactcccaggtcccagccccaattattgaaaccacgctttcgtgatatcatgatcatcgaaggcgcctgtcaattttgtggagcaggaagactgttccgcagaacacgtggagcctcgtgagtgacccaagcaagccagcaagcgattcaacacttcacgctcatcttcagtacgatcctcaaaccacaatcgatgcaaccctaaaattttaagcaaattattcgcctcgtctcctcgcaaacctctcatctgctcgccgtttccctctcttctttgcgacggcgaaa

SEQ ID NO: 12789 - DNA, 1059 bp, Zea mays
ttgagctagcttagatcggcgacacaccccctacctggcgcgccagctgtcggtgttttgggtccgaccgcacacccggggttgcccctcaaggtgtttttaggagtaggacggtgtcgccgactgtagctaaatggttcgtgccggatgcacgaggaacaatggacagtgtttacaggttcgggccgcatggagatgcgtaacaccctacgtcctggtgagaatgttttacgtggaggattacaagggaagctctctaatgctagagaatagagagttggggtggatgggtgagtagtgagatcgatcgttctgaaggggtgccccctaggccttatatattcgaccgtgaggcaatacatgcagatgtgataacaatgcgcacctaagagatagtgaactgattgagtctatcctcctatagttctgccgacttatcctcgcccggttccgttgtacggggctccagtgcgggaaagtcgggtctctgttgtggttgcttgctcaatgttgttgggccatccgggcccgcaccgatccggccttatgtcgatctgcttcactggtcgttcttctctaggcccatgaagggatgaccttacgatttattgggcccttgggcctttcgtgaggtcttttatcctttcagtggacccgggggatatctgtcccccacaacaagggaacactaaaaggatgtttggtttgagaaatcactccatccaaaataaagtggtgcatcgtgagtcaatttttgaaatttgatgtgattaccctatttctaatgttagtactaactaactatgatgaatgagttaatgatggatcaactcattaaattacacaaatcaaataaaaaaaaagcaagagggagaataagatgtaatagcttattcctcgaatcaagcaccctataaatctgcccatctaccttcagaacgttgaagcacagctgcacagatctcatatcgcggtagtctagtaatacaataaaccgttgaagcttggttgtgcagaaggtgtcgttgcattgagctgagccgcggtacgtggaggagc

SEQ ID NO: 12790 - DNA, 959 bp, Zea mays
gtttagcatgtgggaaccaaacactcattgatcgatttcgtttcgggaccggctaagcctatttttactgaaatatttatatttagtttgttttaacactttttggctgtcaacaatcaggtaacatccatattaacgctagtgacatgtggcacaaaacttaaaatagaaatatgaaaaaataatacacgattgaacttttaaaatcacaaaaggcaccattctatcttttggtaccgaacagtgagagtagtattcaacgctgttgtagaagtagcagcaagtgtagatggcgggtgagtggcgaccgttcgttaattgacgcgactcgcaaggtgttctggtgggtgagtgacagtccaccgtcgattcatctggtgggtgatacggaagcacaatagtacttgaaacgaaagaagaagatgtttgaggtggttccgttgcctacacaaatgccaacaggcaacagctagaagcacaagcacacgtttccgaatggacgccacgttgaaaacgcacacggaaatcagccgcagggtccgcggcgcgctggaaaccgtgtggctctgctcctactgacagacgggctagaaccgcgaattccgactctggccgcccactgtcagtgagagcggcggggtcacggagaaaccgagccccgtaccatggaagcgccctcccgttccgtgcgtctgggctcgggaaagaccataccagcgcggcagcgcagattccatcgacgccccgctgtcccgggctcccggccgcttgtttgttgtttacttctattttttttgcccgtcagccccaccgcaaccgacgcctccagtcctactcctccacccagctcgccgcttcaggaatccggagagctcgcgtcgcgcgtgcgtgggcgtgggtgcgtgcggcggcgaagcaccagcaccaccctctcgcgtcgcgcgcgcgcgcgcgtctcg

SEQ ID NO: 12791 - DNA, 1500 bp, Zea mays
tattaattctacatttaccccttatttagttcaattgtactcatagcaggagaatgttaaatgtcattttagttttcttatgagtcatttagtatattcttactatttttagcccctaaaaccaaacatgttagagactaaactttagtcccctaactaaactttagtccctagactaaagaaaccaaatatggcctaactatgtaggagatgcaggatacgggatggtcaagataatttaagttgtgataataagactgccataaaacttgctaataacttaatttaacacttctcgtactaaacacactaaacacatttatatccatcgtaccattacttagggattatgtaactaaagaaaatattttattagaaagagtgaagatagatgatcaattattagtaactaacctaataaacaactaataggtctcgaagaatttgtttggctacgctcgcacatcgatctgaattgacgtgtgttagatttatcaacattttttttctaaaatacatagaaaaaaaatggtagatggctgttattttagaaaacaatacgaaatggctagccggggcgtgggattactgcagggccggagctgacattttagaggtaatataggccggacagacttaaatactggtgcctcttctatataaatataattttattttacttatttgatatacacacttttatatcagtagaaattaacgtggtattaaaaatatatcgaaatattcgtataatatcttaaaactttttcgtgatgcgaagtcgatatcaaccttagcaaacaattattttttcacacataaagttgtcagaccaatcggtcaatcttaagacattgtataccttgaatagttcttcaataattttaattttaaaaagttttattcatctgatgccaccgtgtcacaaacatacatggtaaataagatccgataaacaataaaaaaatattaaaaataagaatctattttttcttgaagggaaagaatccatctttttgatattactaaaaatataaatagaatacattgatgtttctcacaaacttaacttcagtatattattattttttcagattttttaacgggtcaaaatttagatacctatataaaaagacatgcggaaggtccatcggattcgtggcctagggcggccgccctcatggtcctctatgtaaattcactcctggattactgtaaattactaggccagagctatatattttaagagaagtcagagccaaggtggatgatgcaggaccctaccaaaccaaccaaagaggcctaatatatatgacaaaaaagcaaatgacagcaacgggcggagcatctgccttgctcgcatcgtccgatacctcttcccatcctgccagaagctgctgacgtttcgagctcgccgcctgcaagtatacatagatttacattggatcgacgccatcgccactacgaactacgactcgatcgcaagcttccccagtagcc

SEQ ID NO: 12792 - DNA, 1500 bp, Zea mays
atagatgaaacgtttttaatgcgtaagggtacgtacaactctgacatgcatgatactcatgtataagacacagttaaaacacaatgtaatacaatgggtatatgtaaaacttgtatcttactatattcattacactaatcagattattataaattaaattgaccaattagctagcctccgtctcgagcatagagccaaaacatattgtctttgtcaagagacgtgtctgaatttttttttacatttacgccttaracacacctgaatacacagctcaagtcatttattgtgcatgccctaatgaatgacaatattaagtaatttattatccatagcaaggccatgtctagaaacctctatagctaatagttaactagctaataaatcattagctaggttaagacacataatgaactaagtgttatttgtgaggtactccttctgtcctaatttataatttgtttgacttgtttggaccaagtttgactggctcgtctatttgactttttttggaccaagtttgactgaaaaattcaaaaccaaaactaaagtatattatatgataaacaatactgcagtaaaaaattaaaataattgtgaattttttgaataagacgagttggtcaaatttggggtaaaaaagtcaaacgaattataaattagaaccatagagtagctaacaattagctgcattattagttgagggtgtttgaaacacaacaactattttttattatataacggttagttctagaggttccaaacatgacctaacgagggatgagttttttttaccaaataagttgtttatttcctatttagattatttaagctagattatataagagcgtctctaaggggctattcattttctctctctgtttgattctctatttatctttccataaagattacattttatatttagcatttcactctaacaractatctatatartttgactattcagagtggctagttaaatttagttaatgagggagtcattttagagagttgcatatcttgggatgtctaaagtctgtttgagagctattttattgttgactagccaaaatttagtttgacaagacatttaactaatctcttggagatactctaatctaggcaaattataagttgaaacatgcaacatacatgcactttaggtgattcgatcaacaagacaacaaaacatctcaaatgtaatatttacaggcagacgttgcgcgacggagcgagcgcggtaagcggacgaagcggtttggttagttagatcgtggcgcgccgagacagaaaracagggtcacggcagttggagtcgttaacaacaataccgacacgtacgtacctacaagccacggaaaggtatgcagctggatccaatagtggaggaaatataactacccaacaaaacccatcttaaaccaacagaccctcgcttcgtttataaatacgcagcgccatacgcccacctcgaacctgagaacctgacgcggcatc

SEQ ID NO: 12793 - DNA, 1500 bp, Zea mays
attggaatgactctatgtatgtcttaacatgtggttttgacttagagataggaatttgagtttgatttgcaaaaacaaaccaagtggtggcatagagtgatccatatatgtcaaatttgaatcaaaataatttgagttcttatttgaagtgattttgtacttgttctacttgcattatgttgtgttggcataaatcaccaaaaagggggaaattgaaagggaaatgtgcccttgggccatttctaagtattttggtgatttagtgtccaacacaagtgcctaagtgtaaaatggtggacaaagtacaaatcaaggataaaggtatgtttctcagacttagtacattgttttatggactaatctattgtgtctaagtgctggaaacaggaaaaatccaattggaattgtcttggctcgagcagccaagactctgctcagtctgggagcaccggactgtccggtggtgcaccggacagtgtccggtgcgccaggctggttcgagcgaagtggccgctctcgggaattcaccggcgacgtacggctataattcaccggactgtccggtgtgcaccggactgtccggtgagccaacggtcggccgtgccaacggtcggccgcgcgatctgcgcgggacacgtggccgagccaacggctagaagggggcaccggactgtccggtgtgcaccggacatgtccggtgcgccaacggctctctggcggccaacggtcggctgcgccagttaaggaaagaaatcgggcaccggacagtgtccggtgtgcaccggactgtccggtgcgccactcgacagaaggcaagaattgccttcccagattgctctcaacggctcctagatgccttggggctataaaagggacccctaggcgcatggaggagtacaccaagcatcctttgagcactattgatcactcacacatcattcttgcgcacttggttgccattctagtgatttgagccccgttctagtatgctagtcttttgagctcaagtctgggtattgtgtgtgcgtatttgttgtgatctttgtgtcttgtgtgaattgctaatccctcccttgctccgtgttctttgtgaatttcaagtgtaagggcgagaggctccaagttgtggagattcctcgcaaacgggattgagaaaaagcaagcaaaacaccgtggtattcaagtgggtcattggaccgcttgagaggggttgattgcaaccctcgtccgttgggacgccacaacgtggagtaggcaagcgttggtcttggccgaaccacgggataaccactgtgccatctctgtgattgatccttgttggttattgtgttttgttgaggattcctctctagccactgggcaattattgtgctaacgattaaccaagttttgtggcttaagtttttaagtttcacaggatcacctattcaccccccctctaggtgctctcaattggtatcagagccgttctcttcacaaagggactaaccgcccgaagag

SEQ ID NO: 12794 - DNA, 874 bp, Zea mays
cccccccccccccccccggtgcgtcttgataattctcggagttagtgcctccatgtcctgacgcggatgcgggcggagcacaccacatgcggatgtgctgtgctgttgcctcatatgattccggtatgctcattcatacctgcctctcctttttttccccgtgggggagaaaagcgggggcagcgagttgtgcgccctgtgagcttgcagctgttccaggttgcaatgcctgtgctgctcgtgctttagtttagtctgcccccatttttcttctcgttcgctttgcgggcatctaaaaatgttttgctaatctttctggcgctggcccacttcgccccctcctaccctatttttgcgggggatgccggggtgggggcttgtgatttttgagccctcgttctggtgcttggcctttttgggagtgttgatgcggcgttatgggggcgctggatctgttgtcaaacctgagctcgtagcgctagcactagcttgtcaggtagcctgcgaggtgatttcttgggccttggatcctgacaaggctcctcttcttttttctttctttctttttatctcataggtatccgccgccgtttgtttgctatgctcgttctgcattaatgtttccttgttcacttttgtttttgttggattgctcattctgcagcctggttatcttgcagagccttttgtagttctgttgctaacatggtgaattaattttcagactaggacttggggattgtgctgctactcagctgaaagtttatagaaggtggagaagttgtggtgtttccctacctgttagtctgcacttctttgttcctgaccaactgctccgacacgattgttgtcttctcaacctctcttgccaagc

SEQ ID NO: 12795 - DNA, 86 bp, Zea mays
cccccccccccccccccggtgcgtcttgataattctcggagttagtgcctccatgtcctgacgcggatgcgggcggagcacaccac

SEQ ID NO: 12796 - DNA, 619 bp, Zea mays
gcatggttattgcactttgttgactcgactctgttaagggcaatggcaaaaaaaggcttggtctcttgggatcaaatatcagccacgtagaactcgctagtgtaccactaagcatctcaaggatcggccctggtgaatatatgtgcgctgtctcgtgcatgcattcttgaatacgagggagatgcagtcatgcagacacagaatatatctatgaatcactacggcaggccactgcgcttgcttgcaactgttgaaaaggttcagttcaggcgatgaatgcgacacggatttgggcagcctgcaaaaccacgacacgatcgagcgcctcgccactctcggcggcgccggaaacggtccagcgtgcgcgtggcggctggcgagcaggagcatccgccgcgtgtttgatttccacgcgcgcgagctagctctgacagtagacgttgcagttgcagaagaaccccgccaaagacgcccaaccttctacagcgccaatggatccattttgatgcatcgagcctgtgctgtgctgtgctgcactgctgcgctgccagatctgaccttgttcgggcggtatctctgatctctctctaagctaggtcgctagctccttgcatcgatc

SEQ ID NO: 12797 - DNA, 203 bp, Zea mays
ggtagtgtttcagcaacagactgaatagttgaattcattattgtaaataggactattggatttagtggcagccttcggaaaacggtgatagcgtcgctatagtctgctattttcttagcagtggttacaacaacagctctcagaagctgctataacaccactatttacaacacagattgaatttttaagtgacatttgactgc

SEQ ID NO: 12798 - DNA, 1171 bp, Zea mays
tgactcacctagccccatacaccatctcttcatcttgtctttcttcttcctcctgctatgccttcttcatcccggcaggcgcacgcgcagcacgtggatcgtagctgaggatggcactgcagataaaatgaacggggccactgctctattgaatggagcagttattttcctcaactatatttctggcacattcaagtacgtgggagctcttgggtcacagcggcaaaaaacaataaaatacgggctgcagacggcggtgggaaagagagcaggacaagggcatcgcttggcaaccacaccacgacgccaacatactatcagctaaccaacagctccgttgccttttcctgtggctgcgagctaacgatccagtggaagtcacagaaatcgcagagaaatcaaacagcgaagatatctttaaaaattgttgtgcgattccgcgaaattaaactaataaaagtcataaagtttttctaaaaatagttacagatatactttattattcaatatactaatatatcaaactgtagaacctaattcatccatatgctaagacaagaaaattggattttttgtacaacttaaaataacgtgtttcatacttttaactattaagttcacaaaaacaggactcaaaatattcatacttgggttccagtgtcattttagacatttttatccttctgcgctctctgtgcccttatgttttttttttttttttgcatgtgtacgcatgtaatctatagatagaaggttaaaatatctaaaacgacattgaaactaaatgtaacatctgtttaagtcttattttttggagtcaatattacgaacgataaaagtaggaatcacattattttgcggtcccagaaatctatatctatctagccttctcctttcccttgcccagtttacttactacccacgcttggcgcgtgcatcggatcggatcccggccccgcgtcatcccttcctttccacggcccggtcgtcgactgtctcgcgctccactttccacggcgaatccattcttaaatgatctacactgctgcataaacccctgcggccgggtagtctcgaagactccacctaaaacggccaggccagacttggtcgtgccggcgtgcggcgtgcccccgagctagctgtggacctgggagccacgacggcgatc

SEQ ID NO: 12799 - DNA, 800 bp, Zea mays
aagtggcagcagaatctycccccaycccgcctttgcgctttaccaattctgtgggccggctggtaataagaagacaagcaacgtaaacatgtcctaggtaaggtagtggtgagatgaatttccccacgccaagcaggcactcacataaccatattgcgcctataatcatcacggccaccgatcactagtatattaacaactagcgctgtgaattgtgatcatcatcgcaatcttatcgtgatgggcctcgatgattgccaaggtagtcactgtagtgcgaacaagggggaaaaaagggttcggtctgtgtgaagtgtgaagagacgaaaaccaaaaaaaggaaatgaccggtggcatgtgtaatcaatcaccgcacccccgcgtccggctcggggtcccgtggtttcgtcgtgcgcggtccaaaaaacataaccgacacagcacagggcgtcccctccccaatcaccgtcgatctcgcgcccgatgctgccgcccagctccgcagctgatgacgtgcgacgccgtgcgcgcccactgcacctctgcccgtcgccagccaggttcaagaaacagaggagcggaccacggcccacggcccaccgcctatatatattgccgcacggcgccccgttgccccaacagcacagcaagcgcaaagagtaaagctccctcctcatcagagctcactcactagagaaagaaagaaaaagggcagagggccagccaggccaccgcgggtagctagcacccgccgccaagcaaagcaaacaccaccaccacccccgccgctcttcctgcaa

SEQ ID NO: 12800 - DNA, 559 bp, Zea mays
tacagaccactccttctctctcctcttctctcttaaccctttactttttaccctcttctttgattttcaagtgctaaaatttagctaaaaatatactgctgaactttaacatcatatatccaaacatgccctaagtcaaaaagattattggaccaatactcgcctcggctgctgcaggggaactgaggaagaagaacgttcggtaatccaatggtaattactagtcatctattacggtgctcttgtaattcaatgataattactcacctaatacggtgtggtcttgtaattcaatggtaattactcacctactacggtgctactagtcctgcccaataaaatgttcttattaaatgtgctgtcagcagcagcacctgcccggtcagaatcattgattgatgtgtttgttggattagtcaagatctctcactgattcgcagcatccccctctgtttctccatgatctgttccttctcctggctgttctccagttgacttgctccatcgcctctccacgactagaggagggaggaggggagctctgatcgattcacccaag

SEQ ID NO: 12801 - DNA, 1500 bp, Zea mays
cttgcactaaatttctattccattgtgttaccaagtccggttccgcattatgtttaatagcaagcttgagcaagtatgtttaatagcaagcttgagcaagtattgtgcttatactaacccgaacttacacatcttgttttaagcacataatatcataaccttggattgaatttggattgttttgagttaaattttaggtgtcgcctactcatccccgtataggagactatttgaccaccttggtggtgaccacaatttctataaccacgtttgtggttgaagccacgtccccatgatgaaaaattcatagaggactagtagttttcttgaagaatttcgaggcacatgtagtaggccatcatttgtgcatatagaccgcttagattgagcgggttatagtcaaggttaaagcytcagacagtatatcatcttctcatcttggactaactttcatgcaatgacaagctcatcaccataggccttcatattagaaaagtacactgggtggacatactgcccttattagtgttcgacaactacatcctaatgtttgacacatgtgagggacgtggccacaaacttcccttcaagattcatccaaactaacgatgttgtggacaatgtgacaacttaagacgacacttgtttttttcatgtaattgacgagaaagctgagcaactactgatcttatgccaactagtgctcatatgctggattgataagaatgttcttgaattttgcatcagcgatgtacgtgattgccttttacggcacttgaacaatcgaatctaggaacacgtctaattactccgctctaataaccaaaagaatttgtggtctcgagaggagaaagttctctatggttagcttcttaagggctaatttggtggtcaccaaaccagccctaagaaattaattgtaagaccaagggacatcgaggcgaaaaaagaccatgccataaaatgaatatgtatggaatatcgaaagtgattttgactaccatgtttatgtatacatggacatcgaagtatgctcaccatagagatctatgttatatatactagcgacaacaactagatgtaagatattaaaaattgattatagcagcttgaaatacagttcaagaaactaacaaaaatatatttatttttctatatatctttaaagactgctaatttaattggtgatatatcataaaaaaagatccgtatacgatataaaaagatatacacgtatctatctgtatagtcatcagtaggttactcaggttcaggagcgcgtgcgtgtaggcacaagggcccacaacagggcccgcccgtctgtgcacggatatgcgcacgtccaccaaccatctccaattctcaactacaggttctacatgagaggcagaactgcctgcgtcgtaggattgtgggactcccagctggtggagtggagcttccgagtgtccactccaattctccaacgccagggtgttgcagacttgcaggcagtggaac

SEQ ID NO: 12802 - DNA, 1388 bp, Zea mays
agataagttttaaactgtttttcccctttggtatctgatttgatacgcatatgtctatttctaattgcaatttatcatttgttaaatggatggtttgcctatcaaccagcttaaaattatttctcaggctgctgaagctgttaccacaatgtatgcatacacattgtttgtgtataggtgtgcaggacgaacaccatccggcacctatgatccctttgctaaaagaaacaaaattaggatggcaaaccataggcataaggtgtcatacaggcaaaactattgttgccaccttacattttgcactaatcatagacagcactaatggagcaaaccataattgtctatcttactaagtcctgttgactcaaacgcgtgaagaggataaacatacatcgttagagtgtacctgtgattttcttaatacaagaaaaattgaaggatctgacttataactacatttacaacagtgaaattttggatataatgattgaaacactgataaaccacagtatcatttatcttttacacaaaatcaactattcataggaatatacaatgtaatttcaaattcccattcaaatacataagtagtgccaggttataacacttattatggggggtgaacaaaaaatagaataaaataaaaatatcaattggaaaaactcccaggaaagtccagtgcaacgctaggtggatcagagttttcatccacttgatcccatgaacattaggacctggcactagaggtctgagagcaaagaagagcttctgcagaacaaaccaaactatctagtgaagcaaggcagtgctaccttattgaataggagcaatattacatcgctttggcagacatgcaagtcatggaagttttgtatagcaagtccacaggacatagtaggatagacctgtgtagtttgcttcattagtgatgttgatgaatgattgaaatgtaagttagctgcaagcctgcaatagtgtgactatgcttatccttacttagaatgcatgtctatatggattttcggccaagctctctgcctctctttaaacatgtgtgaagtgcgggtgcctagaattttaatatgttacaatgctcaaatttatgttctctatgctatcagatatatcatttttagctctgtgtacatagtcacagtggttagcattgatattgactagggtctaggaatttgcttaaatgtgttacttgggtttgttctaagccaccaagttcattaggatcaattgattttggtattctccaatttaattgatatgttaatatttctatgttgagctttgcaaaacttgtattcaaattttcttttaccaaaaccatgattatgtgctgatccgtgattattagctattgtgcaggctgtgcagca

SEQ ID NO: 12803 - DNA, 1154 bp, Zea mays
caccaactgtaatcaacacgagattaatcttcctgccttcctggttcccacttcgcttgcttcgtaaggaagtcttttttcttttgcctttccctacttccgcgtgcataactgcatatggtccgtgtgacggttatgcgaaatggaggcgggattaggatggccattaaaggccatggttgtgcacatcacctgatccatgttgttcttatattggagtcttagtccattctcaatgcactattttattgtactgtttccaagatatcataacatttgtctagtaaacaatatatactgagtttcatcctcatgaaactctctcctctccataaaactctctcatatttctttttattaaattgtatttcatgtcatcctacttatatatgtgacatgtcgtagaatgaaactctcataaaatatccattgagaatgtacttaaggccttaaaggttgttggccctaaaccctaaaacactgcttgtttaatacgagatgtaacataaatgataatgattcacacttacatatcagtgataataagtttaatagactagtattagtttctagtgttatagtttatagtgttatgattagtcctaaacaaacatgataccaaacggcatttcagtttccttcgcgtcctagcccgggcagccgggctgatgcccagacaagaagcatccagccccacttcaactcctcactccacagtccataaacgagactggtcactggttcggtggttcccagccttgctgtgcacgtaggacacgacgcgccatggtcggcgagccatttaacgcctccttccctaccccacgcctaccactctaccaccccacccctgcccgccatcaatgcggtccatatgcgtgcgtcgccttaaatcggcctaccaccctccttcgcccccgccgcagcacgcagaattttcttactgctggctgctgctcgccattgctgaccacactcacagcagcctccctccccctcgccaccgaaagctagcccgttgcttgcaagcctcgccaactgccgctatatatacgcatacaagcgcgcgccgcgcacgcgcagcacgcaatcagaacagtggttgctggagagcgcgcgggccgggcaaggagcaaggacgagcagggtcgtcg

SEQ ID NO: 12804 - DNA, 1500 bp, Zea mays
aagccgacgtgccaccgtgctcgaggtcgccctaggacagggaagagaagccaagcacggggcgcgcgccaccggccatgctttggcgtgcacctcctaccactccctttgcaggcggctgcactcgcagtcattctcttcgctatcgtgtccgccttgttgctccttgtcctcgtcctcgccgtgtgtgccttccgccaccatcgtggcaactgctaccacatcctatcgctcgaccatgtcccttcgtcgctgcctctcagcgtcaggctcttgcctgccgacatccgccgcctcctgagcttcgccttcccctccacgtgtggctgcaccgacgatgagactgtcatcgactctccctcataccctgtgtgacttgatgttgcacgcgtcgaggagcgaagacgtgtgatgtcggccttcacgcacgcgttccatgctgcctgcgtcgaccattggcccgtcaggacactcgtcctgcgttgtaaagaggaatagaagaggtatgatcccataaatctttaccatcataaagacttattattttgaattcctaaacttcttggttgcaacatgtttagattgatgtgttgtaacttctacttggaaccaatataatgattaagggctcttcgtccaaatcgtttgctagagttacttatcaaatatgacggtgtggtataacaccgacagagcattgtacttataaatatgaagaagaagaaaaatagacaagtacggaaaaaaacgagaacgagaccaagcgaattgggagcggcgcggcagccagagtcatctggaaggttcgatcgcctatcgcaatagaattctaaccgctgagttttggattatttttcttactctagggcacatattgtagtcgtcggtgcctaatctcggcagaaacaagattgatcacgcatatctgggccaggcttacccatgtcggtgtctaagaaataacacacagaggaattcactatcgcgacagtgacatccctctgtacgttatttataataatatttggatcaaaatatttataataatattatgtatttatatcgttatgtatctatgtttaatcacggattttgtcgtcatcattataatcatgttccgtgacatcgcacggacaagtacctagtataatgattaagggcacttcgtccaaactgtttgctagagttacttatcaaatatgacggtacaccgaaagagcattgtactataaatatgaagaagaagaaaaatagacaagtgtgaaaaaaaggaaacgagaacgagaccaagcgaattgggggcggcgcggcagccagagtcatctggaaggttcgatcgcctgtcgcctcgccgccatccattccttcccttgcgcccgaagaaagacacggaaattccccccaactgataaaaggaccatggtactcgcaaagcgataggaagccaccgaaggagagaattggatagcagagagtttgcgtgtgactgtggaagcagag

SEQ ID NO: 12805 - DNA, 421 bp, Zea mays
tgttacatttcttctctgtttgcatctaaattcttttcgttgacgtatcaactgagatgctaatcctgggttcacttttgtatagtttgtcagttaattgttatttttgtataaactgagatgcctaccccaatttgctcgagactaaaagcctttgtttttgttgttgtaggcagaccatgtgatctctgtgatgtgctgaaggatttagttgcaggagcattaccacttgcttataagcagcagcgcacattagatttaacagaaatttcacatccacttcatgttgctgttgaggaatctgctttaagaaaagccttgagtaatctgattgagggagcgctcctacgtacacagcatggtggagtagttcaaatatgtgcagtcgaagcacctgcaggaggcgctctcgtggtcatcg

SEQ ID NO: 12806 - DNA, 281 bp, Zea mays
actacacgagacagaacaggagaggaacagtagggagaaagggaagcacgaggaggaagaacagagggactgtagtattttcttatcaatgatactagggtttctttcaccccacccgcatacatgtatgccttacaaggcctgggactcagtttacccactcgcggcccataactctcacatttggcttgcgcttgcgacggcccagtagatgatcagctccttcgcttgcttgtgctggcactgtatttcccttggtgctgacaattccctccccatga

SEQ ID NO: 12807 - DNA, 504 bp, Zea mays
tccagccgccacgatggcgtgtwcttagggcgctagctctcccccgctagacacgtagcactctgctacaccccccattgtacacctggatcctctccttacgcctataaaaggaaggaccagagccctcttagagagggttggccgcgcggggacgaggacgagacaggcgctcgcttgaagccgctcgctccctctcccacgtggacgcttgtaaccccctactgcaagcgcacccgacctgggcgcgggacgaacacgaaggccgcgggatttccacctctctcacgccggtctccggccgcctcacttccccccttcgcgctcggcctcgcgtcgacccatctgggctggggcacgtggcgacattcactcgtcggcccagggaccccccggtctcgaaacgccgacagttggtactgtcggggaccataattaggggtaccctcgaggctcctaattctcagctggtaacccccatcagcacaaagctgcaaaggcctg

SEQ ID NO: 12808 - DNA, 126 bp, Zea mays
ggttagtaagaccacacccacacacaagtagaccaatacaatgctgctgcagaactacctctaccctcctttgctgtgttctcaaaactcgcagccgcgctaacgcatggtttgccctcttggcag

SEQ ID NO: 12809 - DNA, 1500 bp, Zea mays
ccgattggaaccgcctggagaagaagatggagccgaaaaataatcttcacttcacccctccaaccaacccttgtgccgttgtgcggactccgcaaggccggcggagcgcgggagcaagcgagaggcagaaccgcagaacgcgggcgcggacctacacctactccgttcacgactttaaatatagctgttgcgcacaaaaatttttttctaaaaaaataaaaagaaagaaagaaaaacacttgagaacgttggtagggtggcggagcaatggctcgagttattggaatttggaagacaagcagaaaggcacggtctgctacgtactgttgacagcacgagacattaggcagatcccgattgatgcctagacggatgattgggaataataattgcaggatagggggccggggccaagccaagggcgcatggccgctcggtggagctaagcagcctcgccgaacagctaatctcccctgtcgttggttcgtccaaggtcgcaggtaaataaaaaaatacccggaaaagaaagaaagaaagaaaaaaaaagcaagaatgttggcacgagcagcgtgccccctcctgcaccgcaccgcaccgcacctttgtgattgtgaaccaggcggccccacacgccgcgctatatacttcttccaaaacacaagttcaagacggggcagtaaaagccagtaaacgcagaagatgcggtccaattcacaatcattgcagctggtgcggaatggtactgctggatcgggatgcaacgagtgcctcatcagtctcacagcctgtcacatttacacataatgaaatattagagtaggatctagtttactgagcagtgtaattattatgaatcatatatatatagtatccaacaagaaatttgactgtaacaatcatatatatagttgtcagtaaaggtgatttgctaaacaatattgcaactactccagctaccatctccatctatctataatataaatcgcgcattaaaaagcgtcacagtagtttgctgtatgccagataagcggccggtccatgagcctggtccacgcgccgcgtgccccgcacgtccactagcgcctgtctccctcgttgcaatcaccacgccgccggagtccggagggcagcgtgcgaactgcgaaaccgaactcggggagaggaaggaatctcctaccagccggcagccaacacccagcattcgtgctcccgtagccttcgtcgtccccagccccacggccgctgcgtcgccttcccctctcggtcgaaaccacaacggcctcttccggcataacaatatgcaccgaatattcagctcatccgctctcctataaaaacgaagcgcaaatccaaaaaaaaaaaaaccccgcccgcacgacgcattgtccgttccgtttggacccatgatatatctcgctgggatcttgaccgtgcgcgagacgaatctcctcgtgcggtaaccgataccccccaagtcaaaaatcagcccataaaattttt

SEQ ID NO: 12810 - DNA, 665 bp, Zea mays
gccctgggatatttctttcccatctacgttctccgcaggaataattcccgaaggatatctcgttttcatttaaattataattacgacatacatcttttattattaatgcaaaacatttttacttatacttatcgtaagacataataaatcattatgtgtcattaaaatgaacacatttatataataattaatctctagacaaggaaattatttatttttattattaattagtttaaaaaacattgtcgtatgctggtttaaagggtctctgggtctccgcggggaacagagatgggaaatgcttccctgtccccatcatctcggaaagaattcctctctattttatatcataaactttctcatcttcgctctctagatttctgtttgagtactctagtattgatctcaatctataatattaaagtgaattgaggtataaattagtttaatttacgtcttaattcacctcaagattgagatactaggccttggagggaatttccgtggagaatcaggatcggccccattgccgtctctagcaccactagtagcgaagccactggttgttgtaggtgcacgcaccccaccccctcctgccgtcttcgatctcgtctcctcctccctacccaatccctcgcggtgggcgagggtggaagcgagtgacg

SEQ ID NO: 12811 - DNA, 486 bp, Zea mays
ggtaaataagaaaggaccgtagtaaattcagcaagattgagcaaaattccttccaaacaccttaaggtgaaataaggtaaaggatcaagtagtccagattaacgccgtcctatcgttctctcagtaggacagattgtttgttgtagcctctctgcgcccttctttaatcttatagcaatttgcggaaaaaaaggaaatgagccgtagctcagtggtatgctcggcagttacgagcggccggtcctgggttcgattcctatcgcccacgatttcctacccattcaggtgggagcctctccctccggtgacagtaaaaaaaaacaatttgtgggaaaaagttccaaaaatggaatgtttataacttggttaattccagtgcatcttatatatatagtatggcttaaacatctcatctaacctttctcaggcagtgctttggatattagcttttgcattttagtggatcggtactcccaggggttatgc

SEQ ID NO: 12812 - DNA, 773 bp, Zea mays
gtttgttgctagagcgacagctaccagaacattgttgtgcgaaaaaataggatagtgatgagatatgatctgaaaccgcaggttgatttcaaagaaataagagattatttataaaaagatgacgtgagatgaccgttgaaactgatgctttaatatggcagatagaaaaaaataaaacgtggaacactgtagagttaatcggtgtgaaaacgctgtagaatcacatgcatgtacaccatttaaaagaaaacaacaatactgcatcccaacaaatggggcattattagagtttcagtatgagaaccctttccctccgctatacagtgtaatctaaattcctgctatattttggaaagctgttggaaaacaaaaatgaaagattcgttaatttcgcattattacataacatcttctatatatttcatatactgcgctgaaactcaaacgatgagttttgagatgactcctcattgacatgtccagcgggaaatctgaacttttgcaagacatgctcatgaatcgctaaacaagcaaacatttgtctgccccacgcagaacaactacccatgagcacaagaattttccattttatttagaaatgcattaccgcttaaacccacacgaatgccctcctccataaactccctataaatacattaccctccgtgtcagccctaacacagcaacgcaagcaagcaattgtcaaccgactctatcttagctctctttgcaagccagtaggtcaccactcaaaagcttgtgaagcaggtgag

SEQ ID NO: 12813 - DNA, 496 bp, Zea mays
ggagcataattagtggatcaacggttgatccaagcctgcagtctccagcctacacgcagccataaaactgatcgtgccgctgccgcccgccgagcaggctgctgcccgacgaccgtggagcccaccacccgaactccttcgcagaacacagcatcccacgccggggcggtgtgccagtggaccattgggctccaagcctccaagaacagcacgacgtgggggtgccctccgagctccggcccctacagcgcctgctacgcgtccccggaaacccacccccctcgcctcgtccttaccgttataccccgagtccccgacacaggtctcgctcgctggtcgcctccctcgtccctcgcatcttctccctctttctctctccagcccagtagcctgtagccccccccccctcctctctctctctcttcctcccccactcgcacagtgcccaatgccgcacaaaccctagtgcccccactcccaatctcgcgcggcggcc

SEQ ID NO: 12814 - DNA, 935 bp, Zea mays
ggcatatggatgtaccactggaaactggatcgcgaagctctgtacccttgtgtatcgctcaggatgaatccaacgagagaccttgtccttgtaatgcagttagttgcttttgtgtacacttttttttttgaaaaaaattgtatttgttgaaatcctggttgaagcgatcctgctttactttgcttgttaagttgcgggctgatttaatccatgcgttggagcttatgcagttcagatattcttatgattgcaagtttgtgcgggtatttccagtgtgtctccttgtccatcatcgtgaaactaattgttgcattagcctattgcgccgtcctttatttgcagtgctagttttcagctttatggaaacaagttcatgatcatgtgactatgtgagccccgggctagtttttcagatattcttatgatcatgttttccatgcactgaagaacgatgcatgggccccgggctagtcgtgacagttgcggtgtctgttgggctgatgagccaagcttcagagggttgccgtcagccaaatgtcggcagaacatgtgactatgtgagcgaagtctgtgaaacgaagctttggtccaaaacggagtgttttttatttttattttttgaaaatttggtcatgtggttctcagaattcttcgcccgttttctttgccccacagtcgtaaaataaaatctcgtagagactgacgcgttgtcgcggagtgcagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggcc

SEQ ID NO: 12815 - DNA, 66 bp, Zea mays
ggtgcgatgatttagatgtttgctgcgtcgcgagtccgttgctctgatctcctggtttgtgcagac

SEQ ID NO: 12816 - DNA, 556 bp, Zea mays
ggtatactagccgagctcacggtcatgagtagctcaggactctctaatgattaatttatgaaacttaaattcaattttgtcatttgcattgcatgggtttattattaatttgttctattactttatttaaggtttggtatttacttacatttagtaactgctaataaaattttgaccaactacttaaaagcaatgctcagctttaacccctgttgttgactagccttacacatcacatgaactcccacctttggtgagttcatgcccactggtttccccataacttgttgagctatgatcatgtgtgagctcacccttgctaactcacacccccagaggagaagaacaggtggttcaagaggagccacacagcaaggagtttgatctgatctaggtggcgtttcccagttgacttattggcgccaaggatggatttagttcgttttatagttatcttttattttgtaagacttccgctatgtaataagtactctgatgttattgtgacatttatctctatacactctgttattatatatgttgtcttctttggcgc

SEQ ID NO: 12817 - DNA, 153 bp, Zea mays
ggtactatttgtttactctgcagtttctgtgctatggacacattatttttcctttcagtacgatcttatttcttttggataaattaacttgtgagaactcattcagtgtttgtcttaatgtaggatctacagcttgatatatctgggagatgc

SEQ ID NO: 12818 - DNA, 1500 bp, Zea mays
atactattatttatcacgcagcgtcatttaaacagatcacaaacaaatcaaaattaaatttctcctacctaaatcacatttcaatgaccgaaaaccggtcgagaagtggcggaaaccgccgagaatatcgagaaacagaacttcgaattgtaaaaaaaaaagttcaaaccgtccagagtactgaaatctgccaaatttcgagcggtttcatattttcgcaaggtaccggagggagggagtataacttagtgatgtcacatgtaacatgacacgtagctttcgcataccagaatactgggctgggaatagccattggcagccaacggagacacgcatgtggcacgaaaaacgaccgggcacgcgccccacaccgtcggctactgcgttcgcctcgccgtcgtacttgcaggctacctatcgtatcgtatggatctctcccgaatcccgttcggcctggccgccggctttggacatgcacgatgggtttgggatcgcgtcgtggtccccacaggccacaggcgacggagttagtgacgactgacgagtgaggcagcgagccgatcgagtgatcccggggcgaccaccgcgcgcgcggagtcctttctttcttggccgcgaccaaaagcgagctcctctgctgcttcattcgttcgtctacccggtatgcttttatttcatttcattgaaatcctttttgtgttgctattgcagtgagacagcaattgctcaggtctgtcgtctgaaccacgtgacccgacacacacacacacacacacacacacacacacacacacacacacacacacacaaaaagcaggtcactcacacgacatcgccccagccactgccaggaacggcaaggcgagcgaaacacgagatggagctgaaaagaaaatccggaagcgaaaacacggtcgatcgcgaggccaaaccgacgaacgaaagcgtcacgcgatccgggccgtgtccgtgtgcccgccgcccggcgtatagtacgcgacgcgacgaggagatggcgttcggtcagcccacctgcttattcggcgggcgggcgggcgcagattgcactggagtatgtagtgctctctggttttcgcaaaaaaaagaaaagcttgctaatagcctggtcatggccgggttttgtgttgctacttttagctactgattgctcgctagcaaagttggtggcctttgtgtaagatggcactacctctgcatccttctccttcctttcctacgctgtatctctttctttctttctttctgtgtgattgtgtgtggaattcggccgctcctccgctatatatatagcgacgcccggcccgcacacagacagctccagagtccagacgcctgatcggaaagcaacgtcgttgcccccacctcgtcacgagtcagagagctacacaacaaccatcctgttcccgcccgcatacaggactctagctagctagctagcgttgttccgttgtggttgctctcgctctcgttcggtcgatc

SEQ ID NO: 12819 - DNA, 85 bp, Zea mays
aatggattttgaaaaaaaatggttgtgcattcaatgctcagccagtgtcccccttgaacaatatcactggtaagttggcttctag

SEQ ID NO: 12820 - DNA, 724 bp, Zea mays
gttgtttagagactattgaagttgatcttagagatgataaggagctctaaactttatactatataatttaaagatcagattagaatccaactctatttatatttagttttaaactaaattaatttaaagctcaaacaaattataaataaatatttggatcatgattcattgccatccttagttagagttaatgcctaacaaaaaccataattcagagttcaatcacgtgggtaatcgtttttcatacgctcgtgttcaagtttaaatctttaaatatatgataaatttatcatattcttttattgtcttgtcaatctcgtcattctcaaagtcgtcgacacgacacgacacgaggccatggaagtacacaacgccattataccgcaccaagtacagtacctcttcccctgctttcggctttgccatcaaccccaaccggacagcgaggtgaagccaagttgccccgcggacgcaaagcatacaggccattttgccgtttccggcgcgcgcctctgaacaaacccgaaagcccccctcatcgccattcctcttcctgccatggcgatcctctttactcctcccctcccaccaccaccgcccctcccaactacaccacaccgcaccggcaccaccaccaaccgagcggctccaggctcctgctcaggaaggggagaagaggcgagccttccttgggaagtcgcaggaggagagaaggggaacaaag

SEQ ID NO: 12821 - DNA, 1037 bp, Zea mays
gctcggtggttgtgcgagccgagccaggcggcagagtagtgagctatgagaatggtctcggctcgcacttcaaggataatagcctgatctttgtcagtaagcaactcaagtgatcacacttcaactattgcacactgcatatctggattctggagcacccatatccaacagcttgatggaggagttgtgatatggaataatcaaccacttatctgaccaatgaatctacataggactatgcgacctgagccaatccataaccaaaacaaaatcatagtgtaccaggtcgagcaaactgacggatgtgcagaagttggcgaagcaggtattcgaactgatctttaccaaaacgctctataagcatgaagccaaattcaggccaggacacatgggtgaggctctgctgaacctgaatgtaaccatcgtgcagcagacccaatgaaattcaatattcatagtagcgacctccaccaagactataggatcgactccatatatacatgtggaaataggacttacagagcttttgccaaagtttggggtgagtgccatcaaattcagggaaaataagtttaggtaactgtcccagatagtttgtgttttggaaatctggtgaagaattgaactcaaccgaagcatggaggaatgtggatgagatggaaggtggtgccccatcggatgctgatctggtgagagccgaggatgctgatctggtgccaacggtcctcgaccttggatagctctgcacgaacggcgtcgatggagtccttgacgctctccaccgtggattccagatgggatttgtttggacaggtgggacctctatccacaacagatcagccccgcaccgcgtatcggactccaggagttgcgtatataaataaacaccacgcccatatgcaacgcaacgcaacgcaactcatcgcccgcaccatctgcgctgcgcttcgccctctcgagtccatcgtcgctcgagatccgtcgtcgtcgtcatcaccagcagcagcaccatcaccagcagcaccagcgagttagcg

SEQ ID NO: 12822 - DNA, 1500 bp, Zea mays
tgcaccagttctggtttgcaggagtgcagagtgagctcgtccttatagctcctttgatttgaaatgctgcacacatagaggctgtggttcgttgcaaggtttggtgtggcagttagatagatatgattggatcaaccggccggggcagtggcttttgctcggacgccgcctttgctttgcctgccgactgtggttgttgctatcattccggcctccttttgggtctcgtaaatggccaaaagaaggagcaacagcgacgtgcatcgccggggacaagctaaaagactgcactgcacttcccggtgcttgttgtcaatttgccaagagatcccagggtccatactgacaacaaaggatacttggacatcttcgtgagacagtgcataggtgggccgggtcaagtatgatgatggtgttgggccctgcttcgtgggaatgcctccatttgcaactgagacctaaccttaacggcgaagaaaacctcccatttatttgcttcgcctgctcatctgtctcatctcatctcatctccacgatttatcttcgtctcaaacgaaagcaatccacagagacaaaataatataaaaaaaactttatttgtttgaactgctacaactttaatctatagagataaaatattataaaacccgtagccataactaaattaaaacggcaaacaacaaaaccttcatttccttcggtctccacgcgtctgcagctctgctctgaccggagaccggacccgtacacgaggatctcagtggtcggcaccaaatttggcgtgcccacctgcgcatccgtcctcattatggccaacagagtccagccaaatccggcagccatttgacattttggctagcgctacacagttatacggtagagtgcatccaatagttaagccaaattattgaaccatttaatttttatcggttctgacacagtttttaatgcattggctctcacacgatttatagtttttgatccttaataatttacgggctaagtatgagtcgtgaattttaatccaaaacctaacccaaatccaaaaaagactgactcaacctaaaaacactgaccctacgtgtccaatcagaaaccatgggctaacccgattatgccaaacaacctataatccgatcttgatttaacttgaacttcgaacaggtctaccgtactgtacacccatgtctcaggctcagccactgggcactgggttccttacgtgtcgtctgcgtcacagccaatcaaacttggcactgcctacgccgcgtccaccaagagcctctcgtagcctcccttaaatccgcagcctaagccccatagacccatcccacgcaacaccttagcgacccaccgccctcctctccgctcccctcggtaaagccgaaatccctcccccacatcgcacggcgtacccgatctccaaatcgccccccttcccaaaccctcttcttcccccttcccgtgctcgacccagatcgagggctcgatccgtcggcc

SEQ ID NO: 12823 - DNA, 453 bp, Zea mays
ggtaatgataaaattggttcctgcttggaaacagtccagttctccaaaacatggttcccactcccagagttctatagctttgctccytgtctgtgttaatgagttttgctgtcttggggatagacaatttcatgaaggtagttacagctagatgcatctgtgtcaggattatgatttgttcttgtattaccgagatccaggaataacctagtctcaktgcttctcttctgaggtaatgtccttttgttgtctatctaaacttattagaagtgattctgcttagtgtaacctatttcacgtagtggatactattaattgatatggcatgttttgatggttttctcatgtatcactgtgcctcaaggtatcagtattaaatgacaacttactgatatgatatctgtttattttccccacattgattacgctcatgagtgtttctacttgtagatc

SEQ ID NO: 12824 - DNA, 348 bp, Zea mays
tgggagtgggcggcgggacgacaccggagaggacgaggaggcgctatccaaagaaagatgatagatttgcatcgtccgttgatcgaatatgccgatccaacggctcctacggccccacgtgatgcacaaggaatatcctcaccgtagatgcctaatcgcacgggcgctcggtgtcctcagtgtacgactctggcaggtgggccccaccctctagagcgccactatatatataagcggcggtcgcgtctttggactcctctctgtctctctagggtttttgattttagccgccgccgctgctcatctcacatccctcgagaagacgcctgctcctcgccgatcgatacg

SEQ ID NO: 12825 - DNA, 659 bp, Zea mays
tatataataccggtagaacggtctctcctcacccccaattttttacgcattagcattgcttggcatgttgatgattacctatgagatattttgcttgatacttaatgatgcacttctatagatattttgcttgatacttaggttgcacttctaaagttgtccacttgcacatagagaaaggaattattcaagaataatacctagaatttatgggtgtaccaaaaaatatttgctggccatgacaaactgggtgagcacccgagctggtggttgactagaactcgaagactggtggtaaaattctgttctctgaaattggatgttagtgaaagattaggaaatcatcggcagtttacttcatatcattatgctgagtagaagctaggtgatcattggatccagtatatgaagtttgtaggcattagagcaagtataatagcaggctacgagaagtctaaatgctgagttggaggagagagaagaggataatctggctgtaaacttacagccagctgaaacataagagaaccaaaaagcttgtgagagagataagtaggccaaacattttaataatgaagagccaactattatacaaacgggctaaaaggtcagtccttgcagcagccagcaaccggctacattattagccttgttcttag

SEQ ID NO: 12826 - DNA, 232 bp, Zea mays
agcctgccctgtggacggaccatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgc

SEQ ID NO: 12827 - DNA, 251 bp, Zea mays
ggttgcactgtctaacttgtctgcaatccatgaagttggacatgacggtcttcatacagtacttgagatgacagatgcattccctatgcaacgaagtactcttgacgttccccatcaatttaagcatcttgggctttatattggatgcagttggcttgaagtaaatttaatctttgttgcaggccttcgatgaggcgatctctgagctagacagcctgggagaggagtcctacaaggacagcactctgatc

SEQ ID NO: 12828 - DNA, 479 bp, Zea mays
tgataaggttcagagcgtctttgcttatgacctcttcttattcaagcgtataaacacacctcatatatagaagaagaggaaaaaaaatatctatcacatgaagctttttctgctgacatcattgatgaactcagctgacaacactgaatatgcagtgatgcaagcatatgtgcaagctgtcgggactagatcaagtggccgctcagcatattacattattatatatataataaattaataacccctggaccgatcgaatagatcgccacctccctcccgtcctcccctgtagaagatgctcttcatcatgcatgctttaccaacccattctgtttcatccctggatcgatatttaccgcggcaaattcttttttcccgctcctggcgtacctaccgtacccctgctatgctaacgctagtgtatatataatgctgaatgtatatgggaagagtgtcatcaatcaaatactcagacaacc

SEQ ID NO: 12829 - DNA, 1500 bp, Zea mays
ctatcgccatggggatggtccagaactccagatggagacggacgatcgattggcgtgggtgggattgattgatgcatcatgcaggcgtagtgtttcgttcggggtttcttctatctgttccgacgattccgtaagacggggggtacggttggagaagattcatcttgttgtacacatctcttcttgtctgcctggatttttaccagctcaatcctcgacggagaagtggaaaaaggggaaaagaagggatgtcgtgtgatcaattttgctaatagagaaacgaggagacggctaggctatcggccgcttttgttcgtacatctttttttttcttttttttggctgaccgtatctctgtttcgcactagccagaagaaggcataaatgcagacggttgttgatgacctctagttatgagtcatttggtggacatgacattcaggggggcttttaagtgctcacgtagtgtcagagatagatgatagctggcgttttacaagtcagttctgcgtttctggttaggccagaacttaactggtgtgacatatgagtacgcgagcagttgatggtagcattcatcctctagcttcacacagggaggaaaatattcagtgggtttaactatagggtcgtatatatatattctaacgtcagaaatggaatatgataacaaaattaggtcgaatggctgtagagtaaagaagggaagttgtgttcacctggcattgtgataacaaaaagaataatttatttggcatgattgttggaacttcgattacgcttttactgccgcatgtttgtttataatacggaatggttcaggatggaagcctgtgacctgtgttgtgtctaaagctgttatatttttgctgctatcagtaattaactcattctacaactcttttctaatagttattatgtatatctatttggcattaaatatagagtggtccttcattctattgcccatcccaactttcactttctcagggaaatatccagactagtgacaaaatcagtgccccatgaccccatccgtagaagatttctatgcttaacagtcatgaacatgacattgatgtttgctgagggcctgaggggaacctgtcaactgtatgcagtaagcatgggagagttcaaattagttgggcgtattttaatgttgcttattgaagtgattaacgtctgttccaaaaatacatttcttcaagatctttatgctcccaaggattatttgattatatacttttgcattattggttcatgcatgaaatcttatgaagaattggcagatgttctttaagcatcattatgtcctgcctttttataaatggaagcattctagacatctaccattctctttaatgactaactaattaattttctcttctcaatgaaggcatcaccatattgccaaccgcgcatattttcagtttgtagaagccatcttttaaagaacattttgggcagagattgccagtactattacttgtggttaac

SEQ ID NO: 12830 - DNA, 1072 bp, Zea mays
acggcgcactcatgtttaattggagttgatcacggcaagataagaccatcttcaacacaacatgcatgtgaacgtacaaaacactattttacgttatatactatattgtttagaatgaagtttgaaatagtaattaggcctgattcgtttacgcacgatccacttttggattaacatggattggaattaaatccatgttacaatctatgctccaaaaaaaatccaagcctaatcaaattattttattcggttaaactcatcatggattataacccgagggtttgagaattttttaaactatgaaaggtatagattctatctataacttattaggtatgtaacagatttatgaagatattgcacaaatttatattagaattcatggatcaaaagaataactagttttgaaagataaatgtattaaatgatggatttaatcttattataggattatgtgtgaggtatggatttatctaacagaccgagataaaatctacggccttaggtcacacgaggtccacgtgtccgccgcatgaggctatccgcactcacactactctaaatccgtactctaaaaagaatattctatcctcgtcagcaaaactatctactctataccacaatcatctgcgatcatatttactctatattttaattctatactaaataccatatattatattattttttctacttcacttgcttcgctgtacgcacttcacttgctcatctgtgcatgcgtggagcactccggcagcggtgacagtgtgcagtccacgccatatttgaggtaagaggctgcctcggtgacagtgcagtcgggtttgtagtcgtccgctgcagcgtcgcgatgactctaaaggctttacagtccgacgactgcggatagcctgacaaccgcgagccactgcacccatccactcgtacgccgcggtgcgccgcagcccgcagcccgcagcccgcagcccgcagcccgcgactccaggcatccacaaaaaaccatctcccccgcggccccggcaccgcacgctcccgacccggcgagtcccactcccacctaagctgagcggcc

SEQ ID NO: 12831 - DNA, 169 bp, Zea mays
ggtcagtttgccgcatcgagaaatattatgtaatattgattgtcgagttcttttttctgttttaaaaaatttagtacttgcattcatagtaacatttgatgcattaatgtatacatttttattttcatatataggcttttgatcatctcggcatgttaaagaagaagaa

SEQ ID NO: 12832 - DNA, 1500 bp, Zea mays
aagtccgcatagaaaagttaaactaattataaattagaacgaagaaagtatgttttaatgtctcaactctgatcaattataagtaaaaatattaatatttataatattaaaaatattattatattatttatagaaacatattgttatactaaatcgaccactttaactggcatgcaatccataatcacgttctttttatgacggagaaaagcacataaaagccaaaagaaaaattatctcataaacgatacctgtttcattataagcgtgaatagcaataaaaaagtataagcgtgaattcagtcgcttaacaatccgctttatgcaaattacctatttttttaactcaattataaaaccagttgtaaaaaaaacaagtatgttgcaatcatatgtacggtactttcaaaccacacatccaaatcgacgccactccctcaacaccataataaaatagttgaccctttaagattaagaatatgtttgaatgcactataactaatagttagctgactaaaaagtgacacttgaaattaaccagctaattggctaattattagctaattttagctgtgtggaaccagctaataggctaatgagtagttgagagtgtagctaatagttagttggactattagttaagatagtttagatgttagataatagctaaactattatttagaatgtttggatatctctatctaattttaacagttaagtatttaatataatgtatttaaacttgttctaaattttgtcttaaaatagttgccattgtcaatctttaatggacattttttttgcttctgttacatatttttttatctaatacatctatatctctagttttaagtggtattttggtttgtttgtcttctgtattggtctgaaggacacatacgatgtttataggttatgaagcaacacgcgcaagctgtttttattttcaatttcctataagaaatttacaccaaatgtgtaaacatgctttacttccttaacattatttttgtcatcgtaaaaatgaaaacacggtaaggaaagatataatatgtaaggtataaaccgtgcaaacaagacataataatgaagatgaaaaacctttctaaaatattcaagaaagtgatagttgtttaaaaaatatgtatatttttaaaaacctctcatctctatccttatgtttatttgtagcaatgggttgataaatcactggttagctgcgagtagcccttgcaatttacaccgcgaattgccatctcgctcgctgtagttgggaagagggctttccctctttctctctcctcgtcatccccagcgacgaaaagcgtctcatcgcctttctctctcctctctccggaccggagcctactctctccactagagagcgcgggacctagcacgagtagagggagaagttgagggggaggtcgtcgccgccgccgccgccgccgccgccgccgccgccgccgcgaggtcaccgtcgtcgccgccgccgctgcg

SEQ ID NO: 12833 - DNA, 1500 bp, Zea mays
acaccttttagaagttaggatatactaaacttcagcatgagctggtccgcacgagactgggtagtaatatccactccagtcacacagctagcaacatatggtcagcgtgactggcactctggcagttggaccgagtgtgaactggtgtttccatctaagaccggtgtttctccctcagctgcatgacacacaacttcgtcatttcctatcgtagatagtatatatacaccatagccataccgttgatgtaggggaagagcccgagttcatcgcatgaaatcgaggaacttatcgatggctacgttaattctccaaaaataatacggagaccatccaaaattaacttattttttattggctaaaggcattccaccgaaaataagacatcacatatctttagctgttgaaaataaattactttctactacctctctattatcgttaaaaataataataaaaacttatttttggtgcccttagagcatctccaagaaaacatgtaaaccaaccccaaaagtgtttttagagaaaaaaaagcgcattttaagccctccaacagttccctcttctttccctcgtattattcgtgtcccgaatctattgcctttcctccctcaaatttacgtgtcacacattgtttcccaattgcttcagtgcacctggttccgtgtatttttttttcgcgcgcagttcttttggtagagaaagcacgacgtccgtgctgatcagcaacgggcggcggcgtactgggctccggtgcttgcttcttccagatggctccggtgcttgctttttcagtcatggaacaaaatgaacgatgaatatatatgttcttgttttttgatccatcatctcacatcacctcacagtgtagagtactaggatcaatatccatcagctcatcgactgttgtagcgtacaacacaacagaggatagcagactgccgtggccacgtggttgttttaaacattttatagatttgttattagcagtttgttgtagtttacaatttttttagggaatttttttacaacaatcctcaataacaagttttggggaatagtatttttagaagcctcttgagttgctcttacttgtggtccagttcgagagagagagagagagagcgatggtggctttgatcattatctgttcgtgcaacttgcctagattaattatgcaattgtgcttgaccgtcttgacctttgactctaatcagggaaccactccacccagccagaagacgcagcacaatagcaacaggcagttcacttccttgttcctaacccgccgccgcgccgttgacttgaacggcgctgctgcttccctccaccaagaagctcagctcccgaccgcggcgatcggccgcgcgcgccgcgacgtctcgaagctcgggtcttccgttcgcccatcgcaggctcctcgtgccggccgatctaccaccgctaccgaggaaagcgcgaggccgtccggcgccggccggaatccaccacgatcct

SEQ ID NO: 12834 - DNA, 691 bp, Zea mays
taatatatgaactaacaaatatactttaactaatactatagtcagcacagaaagcattgaagagcgatgtcaaacacgtcctaaagcaaagtttgtgcctctagctatttaaataatataaataaatagatatctacctaacaaatgcgtaaaatactgcctggaggaaaacgaaggaaaatagagcgaagaagagttggtggtcggtagctactgctccgttgcccaattcttccctcctcctccctactgattccagctatcagtcctctccgccaaaagacaagaccataaagattactcatagattaaagtagggtttggacgtctgcctgtccatttcggcgtctgttcttagcggccgacaagcggaatctggatcaagtcccctgcttcaacccatcccctctcatcgattcattgccacaaggtacgtaccagatcacttctcctctctcctgatgctcctgcaattcgatttcaatttccttctgggactcgttgccaatttcgctagttcccctcctgtcctcgattcttaccctgcattcgaaccccaacgattaagctacttttgttaccgagaatgccaacgatgtatgcaatccgcttaccttgaactgttttggtccaggcagctgattgctcacagcgtgggatgtgagaattggattcggacccaccgatcgat

SEQ ID NO: 12835 - DNA, 744 bp, Zea mays
actttcactatgtaataaaatttgtgatatttatttttatataattggttattatatgtgttcttcctctttgagacccaaccggatttgcaggtgtaacacttatctctcccctctatctcctctttcggcgcctaaactcaagccgaccgacggcgaccacctcagcagtcacccgcgatcccacgctctgcccccacctgacacaccctcgcccgcgcgcctcccgtgccccgaggccacgtgaattccccgccctgcccctaccgcccagcatccccagggggcatgccagtaatttccttccgccaccgtgtgccgtccggtctccggaccccggtgggctgtatcctcgcctgacctgcccgcctgcgctacgacgctgcaggccgggctctcgctcgtcgcgtttttatctccacccacctctctctctccgaaaccaaaaccgaccggcctcgctttcgccggttacccggtcaaacgcatcaaccgccggcacgtctccgatcggatcacgatggctgccccgtgcccccgccggtcaggccaggtcgcgtggtcacgtgcgacgcgcatgccgtcctcggccggcgccccagccccctcgccgtgtccttttattctcccccgcctcaccgcccgcatccccaattcacgcccccaccacgacttccgtgctcgccgccttctcggactaggggggttcggctcgagatctgatttcgggcgccggaggactac

SEQ ID NO: 12836 - DNA, 1500 bp, Zea mays
tctcaaactttaccagggtgtgtctgtggtattttggtgccactttgtccattgaaccatttggttttgatttttggaatttggtgaacacggttgatctttgaaaagggctgaaaaagacttggagaaaaggctgatttttccctttaagttctctacttgagtgatcaatttggggctgttttagactctttttggggtaacgttttgactatctttggtagatattttggtgatctataacttgtataatcagcccgattcatgataaggtcgttcccattgcatttttacctaatctctgtaatgcttcatgtgttccaattgaatagacttagggtttcagaaacttttctccatttttatatgcatgataaggttaaggtaggcatcctaagataaccattacctacttaaaacttggttgctatgttttagttgtcttggactcaactagacctcatgtgataacaggtcaagggtgtgggtgcagagtacaaaccctgagtaacacctgggtgttacagccctcccctcttaaaaggatctcgtcccgagatttaggtgagatcacatgtggtaaggaggtgggtgactttactgtctaaataggggtggcgtaaattttgagacctttttcccaaccggctcttcgaatgtcatcctctttgcaacttcagaaggaggcccctgcacacttgtctagatgatccatctctcttcttagtagggaggtatgatggcaacttaagagcagaaggcaagggagtgatggggtatggttacgtaccaacactttttgatagaaattcggggtagtttctgcttagaaaatcctcggtctcccatgtagcttcttctttggtgtggttgctccaccggactttatacatcttaactgcaagcactcgtaccagcctcacaagttatggacctgagtaagtgaacaccaatggcccaatcaatagccactgatccaacgaacccgtgcctgatccaatatgttcccttagtccacgtgctcagcgacatacttaaactatagccattacatcgtgtatttgaccgtacaaaatactgttttacagtgaagactatactatttatatggtggaatttaaaatagagatgataataaaataaataactgaagggccacaacgactgtccgatgcactgtagacggtggcgatctaggcatcctgcgcttctctcgctacgtagacaagaccacaaaaaaaaaaacactacgagtaccatacagaagaaaatcgaggattggctgggacggacacagatagaggagggtttgcccctgcacaccgctgcgctactgggaggagcacaagtgtatcgctgtggctgcggcgcccggcagtccgccacaagcacacgcgcacacaggggccaagcgcctacacctacagaggagagacaaggtctgccgtccgcgcgtgcgcggaagaggggacggaggaagaaggctgccagcaatcagag

SEQ ID NO: 12837 - DNA, 1500 bp, Zea mays
aacagtctaatgcgccaccagacactgtccggtgcgccagccatgtcagcagaccgttggagctctgacttgtggggcctctgggctgtccggtggtgcaccggacaggtcctgtagactgtccggtgcgccaactatgcgtgctctgtcctctgcgcgcgcaggcgcgcattaaatgcgttgcagtcgaccattgcgcgcgaagtagccgttgctccgctggcacaccggacagtcctgtgtgacaccggacagtccggtgaattatagcggagtggcctccagaattcccgaaggtgagcagttcggagttgaaattcctggtgcaccaaacactgtccggtggcacaccggacagtccagtgcgccagaccagggcacacttcggctgactttagctttctatatttaaatcctttttcggtctttttattggtttgttgtggacctttggcacctgtagaactcataacttagagcaaactagttagttcaattatttgtgttggacaattcaaccaccaaaatcaattagaaaaagtggaagctatttctctttcaataacaaaaccctcaaaacacccatgcatttagggtcctatcaatctctgatttgagttgacaaatgggcgaattggaagatgccagtattgcttgagtcgatacttgagagctacaacgtcgccgtcaccaaattcaaagatgttcactaccacatacttcgggacacgtagtttctgccaaataattctacttagcctgatccaagtgagagtgtagcaatgactctagatgatagatagagctacacccttcgatgtactattagttattatttagaacagcgacagagtctctaaaatataattttgaccaatatttttttaaatacaaataaacttttaatacattgatgtttttataaaagtacatgttaagataaatcggtgcatataaacattatatttcaaaactacataataaaatggttatttatagtcaaaattttataaatttaacttaaaatttgtccaaaacgacgactaacaggatacgtgaagaagtagttgctattgatagaaactcagctgaatttaactaattagtcagataaacaactagttagatatttagttaaaaattcgttaacttattagctttcttattttagcagtaattagttccggtaactagtaattagttccggtaactggccctggacacccaagtacccaacacccaatagtactccaaggctcgaatggtcgatggagagtgaattcgtggtgctcgcggaggtcggcccacgggatacatccctcacctacgtggcgatgatcgcgctactccagccgccacgtgtccccgaacccctcgttaaatccagcacagcgcatatccccatccgttcctgttcccctcggcgacgccagtacggcagtacgccacgccagtgcccagttgcattgactcctccccggtccccacatcttgccgcca

SEQ ID NO: 12838 - DNA, 91 bp, Zea mays
cagactatctgtatgatcaattactgtatcttattgtattttgcagtgtacactactccggaaccgagacttttggtgttcatttgaatgc

SEQ ID NO: 12839 - DNA, 126 bp, Zea mays
gcgtactgtcttgtcttacgatttgtataacattggaagaggatttgtatgcatgtgtagattgggatgttgtgttagtgcctggagattggatgtttatttggctggtgcacaatctcccaatcc

SEQ ID NO: 12840 - DNA, 333 bp, Zea mays
attccaggacgcgctacagtttgggtctccgtcgtaaagacgcatgatcgagcttggatgggacagtgttggagcgtcttttggatcagttcttccagaggttctttaaggattctttcgtcgtttctttctctgcatgcgttattggaactggtcaaagggtattgcatctcgctgatggtctggatcggttctcatggagtcatttacttttttttttgctacgtcggaactgaacaaacttagcttgtttcttcttttgttctgatctacgttcacttgtgatgaactaagcaatgttctgttagttcttggctcagatccaatgatctg

SEQ ID NO: 12841 - DNA, 786 bp, Zea mays
tacccagacattgtactagttacatactcccttcgtcccaaaatattagtcgttttagctcttaatttttatgtctatgttcaaatggatgataacgaatctatacacatgtgtaaaaaaatacattaactattgtatgaaacagtaaaacgaattagctacccgtgtttcgatgcaagtgctaaagttagcaaatgaatatagaaagacatctataccctaattaatgtggtgtgggagagagagtgtgaggtaaaaaaagtaggagatgtcttttccttgtccctcactaattttatctcactttagcacaccttaaagaaactaaactgctaataaatactaaagtttagcattttatttttagcttgtttcagcatttctatttaatatctaagtgctaaagtttagcaacaaatatattgttagactttggcaccgcctaattgtccaattgagtggcaatggttctatgcgtgcccaacgtggtaacacctcactacatagaatatagaatatagaatatagaatatagaatatagctgcccttcaattattgtgcgcgtgaccgaatttgtttgtagagatcaaatttgccacgcattccgaagaaccctactgcattggaagtcatgcatctgtccaaaatccaaatactaaagaagttggttggtggtatacggagtactggcaaagtcgcatcagtcaccaacactaatcacactttactagccacaccaacgtaccagctccaccccttcggccacacaacccaggtgttcgacc

SEQ ID NO: 12842 - DNA, 303 bp, Zea mays
ccgaggatggacacaggctgtgactccgacacgggcaccagcacaaggcacagcgtcccctcctccagcaacgagaaggtgttctccggccgcagcgtgacggaggcgccaccgccgaaccgcagcgtcacgtccggaatgccgaagtcctccgcctgggacttcccctgcacgtcgtagcacagctgcagcagctgctccggcggctgggcccgcggcagcctgatccggcgctccagctccgccaccagcggccgcagcagcgccgggtcgaggaacgtgagcgtcgtgccggagtcgacg

SEQ ID NO: 12843 - DNA, 616 bp, Zea mays
agacgagacgaatctagtccagttggttaggtctatatttcatactcttatgtaaaagttaaacgtttgatgtgacccgagctaaactttagcaggagcaaccaaacacccccttgatcttgctacatgaagaagtaaaaagtatagtactttactacaagcccggaaataaaaactctcctgccgcctgacagtttggtcgctagaactagaatccatgtgaacctcggacgcggcttcttgtaaactggagcctggacagagagagaaagagaaccggcccccggtaagcacgcggagggcccacgatgacaatccaaatcccgtcccgcggcgccgaatccgctttagtttccgaaaccacaggcgcccaagccagcacactggccactgctcgctcctccaatcactctccgcgcggcgctgcgccagtgcctgcctgtgcgcttagtgccttagtataaaaaacagccccgcgtctacccctccgccgccgctccatcagcaccgttctttcaaccaaccacctcgactcgaccacccaccacgtcctcgcctcccaagttccattccatccaaccgagagctcatctcatcaccagtccgacgatcggag

SEQ ID NO: 12844 - DNA, 1157 bp, Zea mays
cttgattaataggaagcctagatcaaaatcaagcaaacaaccaacaaaatatgggaggggaactcctaactgtagagagagttaaatcctcctactataatgatatatagctctcacaaggatcaccatggtgccaagtgctaactagtggccagcctctggctaccggtaaagctatctccaacagattattcataccatatcttatttcaaaatccactttataaacaatacgatctataatgtaaaacatttttttcacgatcatatacataatcttcttgatatagctcaacgctatagtcgcctttgcagatgttccaatatgactggtgtgtcgcagcagaatacgtaatcggtaatycaagtagcggccaacatcctgcatcccctgcctagacgctgtagccgatggccacaagcgagtcacacacgctgctgcaaaagaaatatagttgaaataggaaaatgtggacatatgagaatgacataattttaaaatatttaataacctaagaattgagaataagattacttttatttctttatatttaataatttgctaaatctgagttttttagtaaccagggtagatatgatagtaaagattgttcagctcgacgcaaacgacaaaaccatcttgaaaatggcagaaagaaaaaattcagaaggagccctcgaatcccggtcctaggaaccgtctgtcaacgcggtcggggtacttgagtgcctttttcttctctcacgtgcgcccctaaaccccagtgtgctgtgctaatggggatcgaacgccctgcgcttaaatcctcgggtagaactctcgcctcttccgactccgccataccaccaatagatccagctatggcggtgtagtcgaattcaatcctgtgcgagaaaacacgaaatcgccgctggctcgatattggccagggctttctccgcccaactgaggtttcgctgccatttgcagggaccgtgctccagttcggcctttcgggggaaaaggcgagtccttcccatttcctcttttttagatgcatgagttgacgaacatttgggagaaacatcccctctttaatccgaaagattcgacaaagaacggctgttcttctgagcaggaatcgtatctgcttgaatccccgggctccggggcgggg

SEQ ID NO: 12845 - DNA, 338 bp, Zea mays
agcaccttgatatgacaaatttttctctcgctccacttatgtaaccccatattgagacatagtagtttgagaaaaaaaaagtctccaccgagcaaacagatgatatgcatgggggcattccaatttttggagagccgctgcgggcagatgtggagctccaagcccccacccatcttcagacagccacgagtctggcaagggcttatgagaggtgcgagaatgaagcagcaaaggagagatccttcaagggagggagtgttgggcctgcaccgccaaaatccgtggcaccagcactggcctagaagccgacaccaaaccccagatcaagcttcagaaga

SEQ ID NO: 12846 - DNA, 260 bp, Zea mays
tgtatggaggatcctagccatcggctaatgttgctgcctgtcgaggtcgtggtggttctggtccgtgtggccggggtcgcaatggccggtttaatcctggtcgcagcagcaacagcaatgcaccaggagggtgcagatctgatgggaacacaataacctgtcaggtttgtgacagaactggacattctgcccgcaagtgctggtaccgatatgatgaagacaactattccaactcaaattccaagagtgcagcagcagca

SEQ ID NO: 12847 - DNA, 141 bp, Zea mays
ccggctctgccttaagaaacgggtgtgacagctacgcccacaattctcctcctactccatcctcaacaggacagcaagaccaccctccctcactgaagaaccaagagcaagaatacccaagaacagtagctctcaccccca

SEQ ID NO: 12848 - DNA, 190 bp, Zea mays
gtcgttctcgttcctcacccgattcttataccaactcgtcccctccttatctccgtcgtcacgcatcgccctcgctcgctccgcattgcccgcatcgcctccaatctcagcagaccaggtcgagtttcgcccggattttcagtgtgggaggggagtggaggtgtgacgggagcagcagaggaagcgcgcc

SEQ ID NO: 12849 - DNA, 1019 bp, Zea mays
gtgcttagattgtctccaacggattttgtaaaattggggctactggattgtagatgatattgtttttagagtgaatttttttttaaaaaaaatatgatagaggatgagtcatgagatatggaatctgacgaaggtaaaagtagaggagcaactagtgtgtgtcgttgcagagcttagggcttcttgtagccgctacagcaccgcatcgggaggggatgcgacaagcatctagtgaccctacctattgtcgtcagattgtacgtaagtgcggcgagcagaggcgatgcatgtttggatcttttgtgcggcggatgcaccggtgtggctcggagcagaagcgatgcatcatactcggtcggttgcacgaggagacagaatttcaaatatgtttgacctagtgagattgagacgctggtatagcagctcgaggacacgaggcacttgtgaaactgtatgtcgagcccggtatacaccggatcggatcgtgcccgtacttctatcggtctagtattttctggccaactacgtatactatactcctccgccttcggtcctttctcctcgtcctccactcctctcttctgaggtcgacggcggcggatggatggggcacgggcgccgcggcaaacaagcgtgaggcagccacacaacactaccagctagttcatcgccaccacgcgccgactaactgccgtgtggcgcccactcggcacaggccgagcctcttctgacgccactgcttcgatcgacgatcggccaggaaagcctcccgtgcgctctaccaatcggaaatcgccacatttgccatgagcctgcccgctgccgctcccgggaatccgtccaggtgcgatgaatccagcctcccgcgcccgacctatatgtaaaccacccgcccgcttccaccttacgccacaggaaggggaaaaaaaacgcaggtgcccaaaacacgttcgccccagagaattgaaaacttaccactgcgaattcaattcgaaagcctcagacccagagagcttccc

SEQ ID NO: 12850 - DNA, 453 bp, Zea mays
ggtacagtcgacaatcaaagtaagttgcatggtgtactaaaccgcacagttcacgatctgcacagcacgagtaataaggctttccttttgtcgcaggattcgattggaaggatcttatgcgttccgttgaagcgtgcgaatgagatcattggtacgacgaccgaagaactggtgatgcgagcacaacagaaccttgcttcctgattccatttccagtcacgatggattgctgtaccttccctgtcatctccctgcaaagcgcgcaccagaggggaagcttagcttctgatcatcccggaagtctattcctagtctcatctccctgcaaagcgcgcaccagtaataaggaggaagctcctggtcatcctggaagtctattcacctgtacatgtgtacgtgtgtatctttgcattgcagtgccttccctctcgtttggtttagcacggagtgtat

SEQ ID NO: 12851 - DNA, 221 bp, Zea mays
ggtacagtcgacaatcaaagtaagttgcatggtgtactaaaccgcacagttcacgatctgcacagcacgagtaataaggctttccttttgtcgcaggattcgattggaaggatcttatgcgttccgttgaagcgtgcgaatgagatcattggtacgacgaccgaagaactggtgatgcgagcacaacagaaccttgcttcctgattccatttccagtcacg

SEQ ID NO: 12852 - DNA, 1080 bp, Zea mays
ttttttcgtgttaaacgggcaggcccgacccatttaggcccgctgcaggccggactcggacaggaaattgagcccgcgtgcctagacggcccggcccggttttctaaccgtgcctggcgggtcgggcttcaccgggcccggaccgggccgggccaggcggcccatttggacatctctagttctaaacgagcaccgtgattaataaaggctaggactggttaatagcgcagtcgatgattatattatcgatagatgatgtggtgggcggcatagacaagttgagcatatacgacgtaaggcttcatgtcatttcgtcaccatcgtacatatatacaacggcaacatgcatgatttgacggccgaacccggcgacccccacgattgacttgccccccttttttttttgaagcagaagcagtacgcaaatgtgatggtgtaggtaacggtgacaatgtgacatcgatatgcacaccttgattctccctttcatggagctggtccaccatcttggaccagcagccgtcgtgccggaaccgccattctttcccggctgcgggcgccactaccttgcttgcacggccacggctcgctgccgcaaacgctgagtaggctaggctcatcaagaagccatcaggccccgcgcggggcgtcttctccttccatgaacgcgacgccgcctgctcaggcagctgggccaactgcagtactgcaccaggaaacggagcaggtgggatcatccggtcagctgaccacagacagagtagcattatcgcaagcaagccgcggcctttttcttttctttttcttttgtcgctcattcgtctgggtcaaacgcacacgtccctttcgattccctcctccataacagatttttttttatcgcattcgcaaccgcccccggcgacgacggcgtctaccgttgtacagtcctgccgccgtatatctatctatctgtcaatcaatctacctgcaccgctgcacacaagtccaacgccggctctctctctctctctctctctctctctctctctctctctctctctctctctctctctctctctctggctctttgctgcgtgc

SEQ ID NO: 12853 - DNA, 327 bp, Zea mays
acgagcaccaccaggtatgccctccccttggtctccctttcctgctgtgcggagccgtgcgcggtgcgcccaaaccttaacgtgatccgtagggacgccctctccttggtcttcccttacctgctgtgcgaaacagtgcgcccaaaccctaacatactatctgtattcggatctgaagctaattacgatgcaaaaattatcgggtgtacatgtgtgcacccatgtcctctaccgttgtccgccgcccctaagcctgtgaatgatgctgttccagctgttgttttgcctcccaggtgtttttgagtctctgttgcgagtgttgtggcc

SEQ ID NO: 12854 - DNA, 600 bp, Zea mays
aacagccccgtcgtgactacactgaccaccgcctcgaatccatcgctccgctactcgaaccagactcattggtgcatactcccgcgtcccgcctggctccggggtccattcgtcgacccatctccggcgaaagcttacctctactaccactgaagcgaaggcgtcacatcggaagaattgtagctgtttgtcctcctcttcccgacagcgcagagcggagatccgaccggacctgggatcgattccttccttttctcggtaaggaagccctagctttgcttggatgagcctttggtgttctcctgctggatcttaccagtgctgccaatcaaaccagagtctctgtcgctgggatgggggtctctccaggccgtccaattcgttacggattcccttgctgtgtgcctgtgtcctgtgtgcaggggagcaatagatagtggcctgtttgtttcccgataattcgagaggggtttagctgaacccacgagttcctccacgttaagcccgccgcgcctggttcggcgatcgatctgactgatggaaactgcttggttggcagattctgggcgctaacggttcctgagggaagctcctggggac

SEQ ID NO: 12855 - DNA, 767 bp, Zea mays
ggtagatctcctccagtgcagatcccattggcgcgcgcgaactttgacggtgatggatttatgggtaggggaaggtcggggggtggtgcagccgcgcagggattgccattgtcatttaggcttgtaatttctcgaggtgatacaataatatgctgtttgtttttaagattcctgcaagccagggcgtgcaggtgtagtttttctggtgattaatgccaatcttcctgggcgaaatgaaggcttgtttaggttccgaagaaattgactgattcgatctaccttttttgaatgttgtagtatacttgtttctgttattataagatgtttaaatttacactatgattaccagtcctgctaatttttaggtttaagatgcaggttttcaatctatttgttatattgtagtattgtactagttactatgggacatattggtcggtaaactatgtttcattagaacctttcgtagcaatgggtctgatgaatttagtcttttgcgctgagtgcggttgtgatatgttagggttgattttggaagtgattatgttgaaggcttgaagcttcctgcctgttgtagtattgctcatcaagctattcccacttaatgcatattctcaatgatgtctatgaaactgggtgctttgtttaatacatcttctctgtgatagtttcagttttgagtagaatgaacagattgtacttgtcagtgtaatgctttgaactagttcactattaaattgtctctgactctatatttgttcagggtt

SEQ ID NO: 12856 - DNA, 204 bp, Zea mays
catgtgcattagatatgttctctaattgaaaatacacattgtattcaaatggtttgtaccatgggtatattttggttcttcatacaatggtggcgagtttatcaaggcagatcgtgatctttttgtttcaataactgatagtattactgttgttcttactatattgcagttcagaagtactagaacttgcagatcctgatagca

SEQ ID NO: 12857 - DNA, 70 bp, Zea mays
tgtaagctctagttaacatttctgattggttttttctaggattttagtgtggatgtaacatactctctac

SEQ ID NO: 12858 - DNA, 673 bp, Zea mays
ttctatcgatagagaagaaccgttcctagtgtaatacctcatgaatttcgtgaataatgagtctatatatagaccaaatttacccatggcatgtatagagttatcacaacagctggtatcacgcaatccgctactactacccaagaaaaaacctctgtctgacacattcaaagctgtgatgctgctacagagccacgtgtcatctacgtagatttaacaccacatcagactatgatgtggcagcccttccacgttggaggccctcttttttcttctaaagtaacccaccacctgtctccattgcaggcagggcccatcagcccatgtggttctcttctctctcctatcggtttttaactttgcttccatgcatggattcctcctcccccaactccccaaggccccaaccgcacccgtcgccccaacaaaacctccgagcagatcacgacctccgctagcttcgtcatcccgcttaaccacaccacaccatcctacctttcctcacctctcactctttcagcactctgcttgcctaacgcttgctccccccacctcccactcccagatcgcgccgcggatcctcctcgcgatcgcgtcctgaactcctgatggctaccaggtcggtttcctgatccctcgatcctcaatcagtttcacggcttctcgcttattg

SEQ ID NO: 12859 - DNA, 1500 bp, Zea mays
tcctttcctaattttcctcacccattcatcttcttgttcgttcccgttcgagaaccatatttctccagggatttctattttttctaaggaattttttataagggagttctattttaccaatcgctaccaaagctttagctcttaattgggagtaaagtatttttacaatttctagccaatatcatggtacatagtaccatagtattttatgtcataagttgtttggttatattcctaaaaactatgtcttcaaaattattgtattatagattctataattatttggaaagtccatttcaatctaaagttttagtgacatggctaacttttgcctaatatggtgttcacaatattgtatccaattaatatttctcaaaccatggtgttttcagagttatctaaaactgtgatattactataacaattataaattatattattgtgaacttataattttgagaaacattattgtcaccctaacttatttcatcctctatatgctcccttccctctcagcagatatcgcgcgcggctgacggttggagcggacacggcggaggagcgtttggcaaacgaagctgaaaaaagcagctcgtgaagctggccgtgtcgcagttggagctcgtgaaaaaagcagctcgtgaagtttggcggacacggcggagtgtccgtacacacagacggctccccgcctctcacttttttctccgatgaccagttctcacaaaaggcaggacgcaagcagcagccatatcctccaggtttcatgattcttctcttcatcctctacttccatcttcctcctttggaactggaggaaggagaggagacaaaaccatcaaagcgatccgtttctcccacttgtctcgcgccaccattattgcccgcccaatcggacgccgccgtatcctcgccgcgccatagttttaaccttgcgtccacgcctgcccaagtgcccatcccacttttcttccacgcaaaggattttctatctctctctctccttttccattttaatactgcacgatctctgatcgattgattcggccgagataactggagtcttgtgttttatttcgggggtcttgtaccaaaatagcgtcgattttatctacttgacccctgacccattctctctgactctctctcttccttttcaattcgggtggctttatttctctcccctcccacgccttgcatcttcttgatgcgttgcgtcccgagtcgaggcagacatcggaggcgcgcgactgactggttggtttagctcgcgttttctttatccggtaccctgcgctactcaatttcgattcttttagctcggatttgagtagctgaaggccttcggcggcgatgacttgattgatgcgaattggggatttcttaccgtttcctctattgatgtcggtgctgaagagctcaaaccaatttgggttttgagggttttttttcccttctgctgctgatcaagctcacaaagatcgctagctccatctacca

SEQ ID NO: 12860 - DNA, 309 bp, Zea mays
ggtatacagtacagacgcaacggacatggctgccgttttaacatttgtcgagggaaacgggtgcatggaccatcgatcatcacgccgtttcgtacgtgctcttgtgaactaacgaacacggtctgtgcgcgtgctgttgcctttgttgcgcgacaggaaccggctgcgtcgggttcaggccgtccgagatcgccgccgcggttgcagccgccgtggccggagacgtggacgacgcggacggcgtcgagaacgcctgctgcgctcacgtagataaggtacgtagtgcattgaaggcagcaaagcgccgcc

SEQ ID NO: 12861 - DNA, 1059 bp, Zea mays
tgcagcacgagccaagccacggccggcacaagttcacactctccagaccgtctctctccttttcctcgatctgcaacacaaaaagcaggcagagcgccaaccaaagcagaaaagctgtgctcagcacagcaggaaaagttcccttggctctgtgtgggaaaacaaatgtttcttttcttcatggtttatttaagtctttaataaattttagtttaaaaataaatgtaaataaagtctggtcttaattctatctagtcattaaatgtgaagtttaaagcttattagcaccctagtgaagatacacccagagagataaagtagagagggaggggttttgttttctgtttctgttttttttttcacgtccaccgtttttcttcacagttcacaccacaatctctttccctctgggctgtctggctggcctgtgccgtcgcctttccggtgcaaaagattttgttggccttgggagagcgccttgggaagcgcggagcgtgttttcctccctccgttccggtggggggtggcaactggcaacgcaaaagcctgactccaatcccattgctgctggaaagcacaaagcagcgatggtaaaagaggatgaaggccatggcgacagagtggccgccgacgctcctttccgtgtggtgtagggatgcagattccttcgcgctcctcctgctcccagcgaggaaaagagagcacgaactaaactaggaaccatccctccccggcattcattcccttgcccttttttcaccgaattgtagcggttgttgctttcctgttcaggtgccttgttcttggcctccttcgcacgcaaagaaccgccggtcgtattgctctccgcactcacccaccgcgctgctgctgctcgactgctcgtggaagggttcttattggccgcctgttcctgctttgcggtttcttgctctgcttttgagtggagccgctgtggagtggacggtgtggtgtggtgtgggtcggcggtgaggtgaaaggcttggtttctttctttcttgcgagggaggataagggaaagggaaggcgaagaggagg

SEQ ID NO: 12862 - DNA, 153 bp, Zea mays
cacatggttgaaatataaatttgtgttccatgttttttaccccccccccccacacgtatttcttggatatctgatttctactcacgatgatttggcatgtaccttgctgagttcaagtcaggtgcgtagaggaaggatgctgcggggagcacc

SEQ ID NO: 12863 - DNA, 465 bp, Zea mays
tcgaattgagcaccaccaccaccaaccaccacttctttgagcatgggcgatcagagcgtcgcgaatatgaactcggatgggctgacgcctagcgccgtcttctcacagatcatgaaccccaaggggcggtgaggtaaagctggtcccattcgttaccttgcattcattcagcatgtttttttcacgagttcgtgctgttacggttctctcgaattaagaaccagacgtccgagaattgtttcatactagatattctgccttgccctgtacttcttccccagtattgcaacgactgtacatctgttggcttgtattgtaccgctgctattgacccaactagtattttactttatgagaaagtgatgtgcacgaactattgttatgagtggtcgtgtgacgtgctgttaggaaggagtctcgactctgaattcgacatgcacacttgataatcagttttcaatctga

SEQ ID NO: 12864 - DNA, 586 bp, Zea mays
ctgcagactcggtaaactttttttgctcttgatctttttgtttttgtgttaatgtacatctgacactatgtatttggtaaaggtaccaattaaatcctccagtttcacaagtaccctgtgtggctaatttatgtggcttcagtggttagcatacttttaaaattttatggtagaggcagcagttctgcctaatcaattatggtagagggtacaaagtacataagtgcacacgaaattacaaaaaaaaaattaaaaaaaatcatagctggaagcgaagctcgcgaaatgagtgttcagcatatctatacaacttttattttcattgcaggcacaatcagaaaataagattaaacgagctatgatgttacagatgctgtttttctgttcaacattcctgttgtttcaaatatctgctgcgatttcgcttcttctgctaccatgctgtctctgttaggagtatattagaatttcttttgttggacaaaaaaaaaatcaaaggagtctgtcagtcatgcttgaatttctgggactgggatcatagtatactattggccctttttattgtatttttgtgtatatatatgat

SEQ ID NO: 12865 - DNA, 111 bp, Zea mays
acccctgttgtgccatctctaggactagctttttatttcattcagaccattggacgggttgtgccatctctgggatgagcactaacatcagttgtttcccttgttctagaa

SEQ ID NO: 12866 - DNA, 255 bp, Zea mays
caaatccccaacataatccttcaaaaatcattcatattacctgtgtttttgttagaaaatgaataaaaacaaagaattcggtgctgctagggtactgcgcccctgaactgaacgagccttgttccttccgaatccctccgagaaaaggcggctccaaaaaccagatctcctcagcaaaatctgtacaagatccgcccttgatttggataacacgagcgaacgtgtggtgggccgtcgagtgaaacaagattcgcc

SEQ ID NO: 12867 - DNA, 1500 bp, Zea mays
ttagtgctgtgccgagctacgattttaagtgtttggcccagcacgacccgacccaaaaatattaagagtcgtgtcggtccaaaaacttaaggcctaaggcacgatgggatcgtgttgtgccggcccggcccggcccaagtttcaggtctattcctgaaaccggatttcttggggtctgcagctgccgcgggggcccaagaggagggagtggttacggtctgcgtacgcacgtgcactgagaagtgcaggacgcggctgcatggggccagccaggccacggctatgggcatggcgatgattgagaacacactgttgagaaaccctaaaagagttttaatgggctaataccgaaactaccctcaggagttcacaatatatatatatatatatatatatatatatatatatatatatatatatatatatatatacccctcataataaagggagatagaaagagcttccatccactgtctctcttgttcctctgtgtgttgggttgctgggaagagagcgggcttctacaaattctcacgtctctactgctgttgggagggttcggagtctggatcggggatctacgacaactacgttgttcaacacgtcatcagcactgctctacctcgactcgtggatccgatcggcaacgactctccaccacgccggcaggtcctccggccttgccgaactgtcctatgcgacagccttcgctcctgttcgtcgagtaacgcggtataaaatctcgatccgtgatttacttttcggcgttaaaaactgcttcgtcgcgcggccgtgcgggccgccgcacagactagccgcatgcacaaacggccgagctgttcttagaagaaacggccgagctgttcttagactgcatgtgcgtttgaagttatcttagaaaaaaaataggatagatagacttgtggactttgacttttttcttgcatggcggttcacattttctgcaaccgcatgcacctcgcacgcagctttcgcttccaccaggaccacctccacatgcacaaacggccgcatcccaccccgcaagccgcatgcaacgatgggctccaccacccctggcgagtggttcactttttcttagaaaaaaataatctgccgcgtacaacggcttgctttgcatgtccgcatgcaaccggatggcagttgacgtttttttttctcggccgtaataaatatttatctatttattattttttactgctatgtttcctcccggatgtgcactataagaatgtattcttgatgaatttgtttagtatttttaagtgcaatttaattctatatgcattatttatttttgtttcctgttgaaaacaataaaaatgcatacttatgatttttttatatatatacgtttggtatatcattttattctattttatttacgtaaatagaataatgcacgtacaaccatttaaatttatgttatggataattggcacgcctaattaagctggagttaattttgcgtgacagact

SEQ ID NO: 12868 - DNA, 1500 bp, Zea mays
tttctcttaggtgtcatcattcctttcaataccaaaagatgagcatcagaccactagcgttagactataaggtgtcactgttaggttcaatttagtgaatgttacaccgaaaggtgagggactattggcgtcagactatatgctatcctgttttcaccatagggtttagggggataaactagataggtgtacctgacgtgcatcgtattttgcaccaggtctagattaagtatttcggatcatgctatgtcctattcatcatatgtttgtaaacaagtatgtgcccaacttttatttgaactactgcttatcatgaatgtgatgttatgatgctttcccatctactataaactatgtatgtttgtttcaatgaaatggcaactaatgtgaagtagtataagttttagaatgtatcatttgtgcatgacccttttttgaaaactaatagttgtgcctggcataggttgcaacattgaaactaggcatcgtttacgctcaaaatggacaccgatgtatgatttaactaaaataaacatatgtacaacaacgttgtttcgttttactatttcgttgaagtaaataacttgagtttttacgaatgtatcattagcttgtatcatataccaaattcatcagactcaaggaagtggaagtcatggtttcggatagcaaagaccatttgagatgtgggaggagtgttgttttttacctttgaactacgacctcggtcgattgagttgaaacctcgacggatctggtgaaggttgttgctccttgctgccgactgcgcctcacggggagacgagcatccgtcaccgaacaatgggagtcggaggcgaagcaagctctggtggcggccccgaggcgaagctagaggctgccggccctcagctcgggtggcggcgttatggagacaccgacgaggtatgcttcttaatcggagtccgtgcgcaacccgaaccgtaggagctcacacgggacgccgccatagcgtggtgtggggtggaggtgggaacccggccggcgaagacggaggtggagcagaactgaggtgaaggaccttgtataatagtaaatgttgttagtgtaaatagccatattaattatcaaacactaaaatccaaatttaaatggaccgaaatctattttttcttcgaggctggttttgggtagttggctttgcctttttatgcgctcttggagtcttgggtttattttactcgtgggcggccgtctctaatgaaattacccttttctgtcgttccaaggaagaaacagcattgcctccggagttttggttgctccaaggaagaaacttgtccggaggcaacactggttgtctgattccgaatacgtagccgcaggcccgcagcgtgctgcaggatgcaacgtctcaggaaatataaagccgtcgtcgtcgtgcacagcgggtacatcctttgcttgggcatgtcctcctccagactccagtccctccagcctccacagtagcacgccacc

SEQ ID NO: 12869 - DNA, 144 bp, Zea mays
ggttctcaatatatgttaacagtcttaaaagatattttgataggatgtctgttgactattgaggcatgctatttcagcttccatgtcctttgttaaacacggtagagcatgggcatgctatttcaggttgattgacacagtcac

SEQ ID NO: 12870 - DNA, 416 bp, Zea mays
ggtatgctccagtaaccagaactgtgggtggttgaagattatgttttcctttatcaagggatctttctaaaatattttcgattctattttagctaaacctagcccagcttgcttgggactaaaatctttggtggtggtgtctatattgtccagacctagttttgctacccaagaacatgagtacattgtagtacttcctggttctttgtgacacctgattaatttgtatatctttgcacttcaatactaactagacgctattgtttttgttcttttcacagggaaagaagataaaagtttctccctcccaggctaagaacaggctatttattgggaatgtaccccatgactggacacatgatgatttcaaaactgcagtggaagaagttggtcctggagttttaaaagttgaactc

SEQ ID NO: 12871 - DNA, 393 bp, Zea mays
agccaaaggtctcgagtttgaatcctgacagagactttatttgtgtccccacccatttatttttacgtttgcgcctttctctctggctacacgtgagtgactgttaaagtgtataagtggattgactaccttctcacatcatcttaagctttcggagaccttctggttgttatcgtattccgctgatcacctaagattgctcatctgctcacgtcggcgacgtcgcgccggccaagggtcgtgacaagtggtatcaaagccattctatctttggaggagaagtggtcaactacggttgtggtgcttcgtgaagacctaggaggctgcgttagggttctatcgactcagaggagggtggcagtattgaagaagaataagggggcaacaatcacg

SEQ ID NO: 12872 - DNA, 711 bp, Zea mays
ttcttcatataagagctagtgcattcactccttagacacaaatcaaaagatcaaagcctctccaagtccccaaaatcattccaaccacctagtgacttgagagagtgtttgttcgtgttctttgtgctcttgttgcttggatcactttcttccttcctcattcttgttccaaagagatttgtaatcaaagcaagagacaccaagtgtgtggtggtccttgcggggtctaagtgacccatttgattaaggagaaagctcactcggtccaagtgaccgtttgagagagggaaagggttgaaagagacccggtctttgtgaccacctcaacggggattaggttctttggaaccgaacctcggtaaaacaaatcaccgtgttaattgttttcatttgatttgtttcccctctctcccggactttatttaagtgctaacactaaccccggcttgtagtgtgtgcttaagtttataaatttcatattccgcctattcactccccctctaggcgactttcaattggtatcagagcctatacttcattaagagtctaacaactcgaagtgatgtcgggagatcacggtaagagggagatcgtgaccggcgacaagcccgcaagctcggggagaacacctcaagagagtccagccacaaacataagaaggaatcctcttccttcaataagacgcatcaaaaaggcgacaagaagaagaag

SEQ ID NO: 12873 - DNA, 1500 bp, Zea mays
ggtctttaggtctcgtgtgccattgccttccaccgagtgtctccggttttgagagtataatccctcgtcctcgtgatcgacttcctccttttatagtacaaggtgggggtcagccattggtggcttccttgagaaggagccactataccatggtaaaaccaggtgttttaccctggtgaggccacattgttcgtatgtgttttggttgcttggtattttctcctcgtgctcattatgacagatgacgtgggcggtgcagggccccagcgccatcattactacatccgcgccaagccaagccctagcctccgtagcctaggtctcggcgtggctcgttgcgttgcaggccctgtagacggcctgtgcacttaggtctagtcttgataggtcatgagtgtgtcgcaacctgaggggggcacgtaggtcatgattgcgctacatgtcgacgggcttcacaagtcatgagtgggaggcggatcagccctctactgcgactcggtgttaggcgtagttagtacggcgggccacttatggcgggttagtcttgggctagacgaggaatccactcagttagcttcccttcggttcaccaccctcctttctagctcatcctcgctcgaccccgggcacggtgccttggtgtttatccgagggtgagcccttacagggaagayagttcccttactccctcgctggccggtaatctagaggtccttatcccatgcgctctttctcactggtgggcctcgagggcccgaggatcattttcccgacacatatcaatctgcttttcctgaaagctcaacagtcctttatttatagccggttatatttaccgatgaaagacgttacaattattggtagcacgagaaaagaagcaatgccatttacaataagcacatcatttcatttcctctattggaggaactgtgtgtgagaatttaatattgtcctattttatcattctagtagcattaaacaataatttcagcacaagacaaacatgacatggatgaaaaattgaaaaataagaatttaggataatgtattcaattaggatggccgatgacccatatatcaaatagtcattaggtaataggtatagatacctaaaaaaattatccacaaatattttattatatctatacccgtaccatagataacaaattctactatatacccgtgtccaataaataattgttcataattatttatccattctgaaatccgtacgcattaccgtcccaaatcgagagttacatgtcgagggtatgtgtctctggtgccacgtgttcagattcgctgctctccaagtagtagcaaagacgccgcgtgtcgtcggttgcatgtccatgcccatccctcgctggtccgcgagcgagctatttattatctgcccccagaggccaagactccaagggccaaggcagggcactgcactgcacgcatgcactgacctgacgacgacgcgcgccacagtccacagctcctcactcagac

SEQ ID NO: 12874 - DNA, 682 bp, Zea mays
cgtaggagcagcagcagacgcagcctttctctggtcgctgttccttgatcccttcttctgcaaaagaaccaaccaaccgaaacagcaattaccaactactacaccctgccgtgagaaaattggatttatgccattatgaaacttaggattcgctcaaatgccattatgggaacacgcttcgctaagagaccactatcaaacgttgtcttacagacaaaatgccatttagggtgttatttgaaacttaaccttatttgattatattggcagctagtgaccggacacttttgcccctatcaaatctgtttgccgttctccctccccccgctctgccgccgctcagctctagatcaaaactgctaagctccgccgttcacaggaaagtctattttacggcacagttttaaaacacagtttgcacggtttcagaacacagtttcaaaacgaacacagattcagaacacagtcggcagacgctaacacgcaatgggatacggcgaacaccgagcagcaggtctctaaactaaaactttggcagcactcttaaccagtcaacaacagatcgccaaccattcgatttcacacaaatgtaatcctactgcaagtgcaacagccacctttagaggcgttcattagcaaacgctagaaaaactgcaaatggccatattcatatcgaaccaat

SEQ ID NO: 12875 - DNA, 229 bp, Zea mays
aagatgtctacagttttcctatgtatactaggtatatgcccgtgcgttgccacggaagttaaaaaatagtataaaacatgtataccaaacaccatgttctagacaatgctagtgaaactgaaataaaaatagctacataattgcttaaatagttatacagctcgtagcacaaacaaaacaaagttgggcataacgttaagtgacacttttcctgtatcagacttggact

SEQ ID NO: 12876 - DNA, 1041 bp, Zea mays
gtttgcatgcctgcagagttacactgatgatctttagactttaggaatcagcaacatgaagacagaaattatgcactcttcccctttctgacctccttggggcctcctcggctcggtagtttcctagcgtggtaacttggtcactccgccatagatgggagatgaaagacatagagacagatacacggccctgattgaagtgcaattatgatttactccataaaattaaattttgtgactttagactcttttgaaaacgaagaataagtttgagcatgttctgttagaggtacttgacggtgtgaaatatagggacaaaatcacagatacccttcatttgtaattgtgattttgccattgttttttaatttgaatgttctgtgattatgatgtctctatgattttttgataaaggaagctttataataaagtttacaaagaacgatacatcaagaggatacataatattagtacacaaaacttccggactctgtctaatgcacatagctaacctaaaaaaaaacaaacataaacacaacaatttccctaagctagcgacaatcaattcaaatactagatcaccacccatacacctgggaaaaaaagaccatgactgttcgcaccaagagtcacggtccctccacaaccaacgggcgcatctcctctcactaaagctttacaatgatgtctctacgataacatgaccaaacttgttcattctttttaaaaaggatgcccgaatcacaaagttgaaatattgggataaaatcataattgcacttccatccagtgaaaaaacacagtagcctcttaattattcgcaagcccatccaacaaaatactatagcaaactcccactgccatagctggttctgttttccccaagaaggcaaaaactcgctaggctcttgtgcagttatctgcttgtcccattttccttattttgactgtaatgaagaattgcagtcaatgtcatctattactgtgtcgttgcatcctcaatttaatcattactgttttgttatcttttacagttgaaca

SEQ ID NO: 12877 - DNA, 1500 bp, Zea mays
gttgtatagtgtggtttgggtacactccaatgatcgctatttaattcttgctctattttgtaggatttttggtggaacaacgagatgcttccatcttattttaagaaaagatgtatgctttgtcgtgatgtgactagggtatgggatggttcatggttggtacggaattgacaagggtttatgaaggcaatatcaagctttctggtgcatgagcaatttctccatttatagaattccattggatttgcccttcctggccagagatagcgtgttttcgcatgcacttattcatatggagactctatgagttttttgggattgttgatgtcaaccatgaagactagctaggaatgatctaattcatagtcttatgacttgtctacatgtttgcaaacatggatacttgaataagtatgtgatgtgaaaaccatatatgtgtgatcatagatgctaatatgaattggaataatatggtacttgtttgatgtgtatgcattgctactgtatttgttgtttgtgtggcggagatgcgaccagcaaatcctagctttgctatagggttatatatatggtttttcatgaaaagatttatttcttcacgaagcggaatatagcctcataaaatgattacggtttattatacttttttcttgagatagttgaatccgaattctacaaaaaattgaaagccctgtgaagcgcatcctatcgatccgagtagtatcgtcaagtcggaaacaatgtaatgtgcaaattagacgaacactttttataacgcaaaaccaacagtgccagatcccagatggagatcgatcatattcgcttaacttgatggtgattcagtgtatgcgcttgcyctatagcaagccatgatcgaggagattgatcgagctcacactcaacacgtcgacgtgcacgcacgcctgcagctactcttgactcgcattaagggagcttctagttgctctcagatcagagaaggggaggggggaacactatcaagggcattaatgccacgcatggatgctgcattaattgtacttaaaaatagagcagcggagcatcgtgtttctaatcttacagacaagccaagaacaggcagctaaagaacagcagggaattgcccccggcgcctgcttagccagcatcaaagccaggaattaacagcatccgaagcacattgtcccgctattttaatcccgagctaagcacttgacagcatccctaatctgatctgcgcctcgaccgccaagctaacttcctcgcgcatttaatgcagctgtgcaaatcctccttggccccccatgtgcactgcgtcaccagtcgcgtatataaaaccacacaccatggtggcgccaacgaaacacacacactcctccagaacgaacacacaccagacgtctgttggcgcgttggagagtacacagctcgcagtgcagagcagccacttccttcgtctacaactaagtaaccagcagaggtcatcgatcgcgatcgacc

SEQ ID NO: 12878 - DNA, 639 bp, Zea mays
tgataatggatcatgatctaaatattttctcacaataagttggaaccattaaataattaaaatttaaaattaaatagaaatagagcctgattttaatctaattaaattcttaaaaaaaataaagtataaaatctatagccaattaccactcgtatacagcgagtactactatcatcagtggaggctaatccgagcccaactagcatttgactttgtaacccatacaggctagctgctcagcgcacgcggagcgctatcacgaaacacgccgactggtgggctcagaatagtagctggaattatagcccacagtgtcagagagagtgtttgcaaagtcgtaggtgttgggcgctcgcacccagcagtcgccgccggcagtccatgcgctccagctccacgcctccaccccaagttggcaggctccaccggtccacccaagttgctgctacatactactgaagctggccaaaccttttaccaaacccaacagcgaccaatccaatccacgtatcccctcccaaccagagcagcccaccaccaccgcccacgccgcgcgcacgcggccccctctccgatgcgcgccgccgagccgactccgccgccaccgccgccgctgtcgctgccccagccaaggtagcc

SEQ ID NO: 12879 - DNA, 168 bp, Zea mays
gatttgatcgagagctcggacattaattatcctgcagctggatcaagtaagtgtgtgtacgtgtgtccctctctccttttgcttgggaaaataaactaaataaatgccgatcgacattatatatatatatatatattctccctctcttattctgcagctactggtgtc

SEQ ID NO: 12880 - DNA, 1379 bp, Zea mays
agcttctctgtatgtcagggatgatgtaggcgcatagaatcgacgagtggcttactgtgcagtgcggtctacttgcgacggcggccggttgaagtacgacgacgtcaatctagtgcctccggcgaggagatgcttggtctgcgggttcggggagcttcactaagctccgagaaagctagccgaggggtcagacggggtggaggagggctggagtggccggtctgcggtggccggggctcgggcggccgatggcacgccgtgcacagagggaacgccggtgaactggcgctcgggcggggttgggagtgagcgaggttgtacggtcgaggccggggtaggctttatagtcgtgggcgcgagcgtgggtgcggggttggcgtggcgcgacgcgatgtacgcggggccgagtgtcggggcgtgctctggcgttgccagggcgcgtcgaacacgtggtcatgttattctgcccaagttcttgcgcctgctgagcagccaaatgtgcgaatattgccatatgacttgtgtaagatttcttccctgcagctagagctatctagttcatgtgagttccaaggggagatcgggtctggcttggaagatatggtggtgccaagtcttgtctgtctgcactgttcatctcgcgacaaaaacagatgccaaaccgtgtcaacccaaccctggtttggtttcaaacttttcagtggtgtgctattgggggcctgcttcgtagctgaaggtcctgtaagaagaaacaccttcggaagatcaccacagaaataacgccgaagctacctcatagggaacgtcggcataacgacatgcctaagacgaacggttgcaccgacttaaagatgaaaagacagattgacccatgatagtttgtgtcatgaatgtaatcaattgtaaagggtataaatgtaatttgacataggctgcgccctgtgcctataaatagatgaacagtacccctgtactgttcacgctgatttgtactcgctcgtgcatcaggcttgtactatcttcttctgttaagccgaaggtacaaatgtaattctatattatttctgtttattcatgacaatataatagaagatgagttaataatgttacattatcattcatgttgtcttttatgtttcacatgcttcttctttcattaatatatgctacgatgatgaaggtatgtccttcatgaccttcgtctgaagatcattatatcccaagagaaataatgcttcgaaggacgaagggcattaaccattaacatttttgtgttgccttgttcttaattcatagcatttaagaacaagtccccaacattggcgcccacctccggtgtactcacttccacaatctttagcaaagcatcaacctttgtc

SEQ ID NO: 12881 - DNA, 1049 bp, Zea mays
gtactgttcttttgtattaatatgtggatgtatgtatgtttgcgctcgcatagagaacgatccggtcgaagagcccgaggaattcacaggagaagcccctgagcagcagtcggttggtggaggcaagtgtcctttgacctatctatgtcctattcattatttaattcaccccccgctttacacatttatgcctaaggattgactagccttttgttatccatgtccttgtttacctatttgggtcggattattactgcttagtttgatgctattgctcaactttaatcaatgaacatgatgtggttatctatgatacgctgttttcccgttcttatttatgattatacttgtggcatttaaggggactcgagcggtttctcgagtgcctctccgtaaggacctgttctatggatgaccgcccgggaaaacagtgcaaccatgagggtggaatggggtgcccttagctgaataattagaggatccgaggtgtagttcacttagccgtcgtgccgtcaatggggctcggtgtatgcggctcgctctgccaagtttgggttcgccccttggggaggagtgcggtgcatttaggaaacctaacgggtggctacagccccggggaatctttgtaaaggcttcgtagtgaatccctggccattcacctcgggagtgaataagggtcttgcaagcccgggccagagagggaatcacggcttgtgggtaaagtgcacaacctctgcagagtgttatgaaactgatatatcagccgtgctcgcggttatgagcggccaagggagctccagagattagtgatacttgatcagagatactttggtacaggtgacaatgagattgatggttctgattacgattatggtattggtaagtggtattctttccgtttggaaaggatacattgggctaataacttgggttaatgttaaaacctggctttctactagtaagtaataacctgaccaactaaaagcaactgcttgacttatccccacataaagctagtccactacagccaaacaggatacttgctgagt

SEQ ID NO: 12882 - DNA, 1500 bp, Zea mays
atctaaaaatactcatatcaagcaacaagtaaataaaacgatacatattacattattatcttaaaagtttcttttaacatgtttagatatgattggtttttaaacatgtcgtagctgtaaattctgtgttacttcgctactaaactattgtgtcatatattaatagtctagctattgaatttatatataggattgggaccctatagatttgggggctcaggctcggggcgccggcccctctgctccaccctgaggatcgtcgttgcatacaagtcaaataagtcacaatagtttacatgggctaaaaagaaagaagcgcgtggtagctggagggtgtttgcaagcaaaatattttttagagttttgagataaaactatggtattgaaaaacagtatgctatattttggtaaaaggtgtctcgctaccttgtaaaaaatctgttttaaatatcttggtttataagttactttggtaactccacttcaacttaaagtttttgtttataactagcttttgtaacatgtacactaaatactatggttgacatattttgtctccaaacaaatattgcttggagtgatgtacaaaaatactatagttgtgtcacgacattttaaaactacggtattgtaaaaccatggtttttgaaatatttggcttccaatacgcctcatacttcggtatggactaaagtttttcatgtcctaggtattgccaaaaccaaggttttatatattatggttttaaatagtctatcaaaacaccttaggtcctgtttggaagtgtagtatttttgcagttttgaaacaatactatgatatttgatgatactatagtattgaaacacaaaagatgtttggtctgtacagataaaacacagttttaaataccatgatttacctaaaaccgtaatatttttagagtttttgaaactccatttatgacctcagttttcttctcttctctctacatatattttgttttttcaatggaaccaaacagattacagttttgagcaatactgtgattttactatggtaaagtaataccgtagtatttgtgtcatgtacaattgtaaactatagtatctcaaaactacaattctaaacaggtccctagtttgtgcctccttcaaaagctaggtttcaaagactttagattgaatttgtgattaatgagatgcgataataaatacgatacccgcttttcactttataactaacaatggccgaacacacaagctcgatttcagggcagattcgttgtatatgcacgtacgcgtgtgcgattccaggatggacgtttgtccattgggcccgcaatttcggcggcgacagaaatggacgggataaagattccgtcacgtccccgtcgtccggcaccacccagagcttgtccctctcgcgtgttgcttcctcggttcctccccagctcaaacttccaagaacccgtgaagtgaagtgaggaggtcggcggaaccggaacccaggcgatacgag

SEQ ID NO: 12883 - DNA, 1500 bp, Zea mays
cataatatataaaaccttggttttggcaatacctaggacatgaaaaactttagtccataccgaagtatgaggcgtattggaagccaaatatttcaaaaaccatggttttacaataccgtagttttaaaatgtcgtgacacaactatagtatttttgtacatcactccaagcaatatttgtttggagacaaaatatgtcaaccatagtatttagtgtacatgttacaaaagctagttataaacaaaaactttaagttgaagtggagttaccaaagtaacttataaaccaagatatttaaaacagattttttacaaggtagcgagacaccttttaccaaaatatagcatactgtttttcaataccatagttttatctcaaaactctaaaaaatattttgcttgcaaacaccctccagctaccacgcgcttctttctttttagcccatgtaaactattgtgacttatttgacttgtatgcaacgacgatcctcagggtggagcagaggggccggcgccccgagcctgagcccccaaatctatagggtcccaatcctatatataaattcaatagctagactattaatatatgacacaatagtttagtagcgaagtaacacagaatttacagctacgacatgtttaaaaaccaatcatatctaaacatgttaaaagaaacttttaagataataatgtaatatgtatcgttttatttacttgttgcttgatatgagtatttttagatgtatctttagtgtttatattggtaaatttatatataaaaaatgactaaagggcatattgtcctggcccctaaaatcttagaaccgccgctgatgccgcatcgagacatggatgctaatgtttaaaacctcaatacctcattatcaagcaatcatcccagccagcagctaaacgaaggccactctcacccctttcccccttccctctcgtccccacccgccatggctcacgagacggaactcgccgagcagaatattcgagagaaaccacttcaactacggcgtgtggaaacccaaattcttcgcgccgtagtatgcaagatcaggtggccgcgttcccctcagctactaactgagacatccacacaaacagcttcaatggctcacgtacctttccagtgcgtgaagaggtctagacgacggcgacgatgaagtcggcggacggcggctagggctagcggacgcggggagatatatttgggcctccgcggcggtggcggatgctgctagaagcttatagaagaaagatgccactcgcccactccgtccaaaaccgggactcattccaatcggacggctgtcaactacgcgagcggttgggacactgaaactagggcccacatgtcggtctcttaaatctctgcgtccctgccgagctcaccgtcgccgccgttgtggttgtggactcgtgggggtcgacttccgccgccgaactccgctgtgtgacctaaagggaatcgttctcaacggcggtgggagcg

SEQ ID NO: 12884 - DNA, 1500 bp, Zea mays
tcctgattagaaccttcgtttcagcaccgctcgctcgctggctcgcccgtgtaccgaacccgtgatctcacgccgtcctttttggcatgccgttgggtttgttcagtacttcaatttgggcgggtggcttgcgctgagatgccggcgggattctgtgggtgatttaggcgacagcgacctgcgttgatgcgttgagtagtgtcgagctcgaggccaccgtatcggatggattcgtccgccctcgagagtttcagtgcctctgcgatgatttctgcgcggatcgtctcataccgtggggcgtggtcccggcgaaggggcggcaggctgctttgttgggaaacaccagctaaccaagcctgttcccgttgggtctgggttagacttggtagggagatcccatccccaccccctgttgcgagacattgctccagactttagtttgagcgagatatttgcctgttgtcccagagctgaaacccgatgtgaaatttgtttcgcctgtgtccttaatttcaccttcagccgaaggctacgtttgttttggtaggatgctgtttactgttgcgagagatccctgactgtcactcccaagtgccaatttgattgaatttgaggtagggtgtctccggatggggtctatggttatgtgggtgctatagcttgaacccagttagatctggcctgaacttcagcttgaaccatcaaggttgtatgtttttcatcagtagttctagccttcactgttacacaaattgcttttggtggtttccagattataggttttaatatggttgcacgatacctttatgctgactcatctactgtcagctgcatgtgcatcacaagttgatgcaaagaaaaaaaatcaagggtaatcgatcacatgattggttgagaagttgtcattcagtaagacaaaatggactttgataatttgttgccatcttttgcactaagagattgtgacaaacaaatcaagttgcggttgccaaagtttatttgcggttctctgtaattgcttctctattcaagaggacaagataacaaggctgtggctgtgctttgttttggtcagtaatgatatctaagtgctctattgctatagatacagatggtgcttttggtcttggtcattgtcatgtggagtagcgtgcacagatgtgattctctcaagattgcttgtgctcatattgtcgtgggactattggtagcttttgtgttggacgtttctcatcttagggtatatgtaggttccttgtgttaccttactatgtctgttgttttctcccatgtgacggtactgagttttacagctgactttacgctaaactgaaaacatatgtccatagaaaagacccttgctcgttgccatttttattccttttttatgtcactcacatctcatcaactatcattaatatcttttttctttgtctgtttgtgctgctaagtgctaacacagtgctactttcattggcagattagtattttaaactcaag

SEQ ID NO: 12885 - DNA, 1500 bp, Zea mays
taacgctcccgttacccaatactccatctccatcccccccctcatgtttgtcctttgtggaatgtcatgatgtcgcactttggtcagaccacctgggattcaagatggacggtcatcgtaggtaccagtgatgtccatgtggcgtcacctccagctattgaattaaatagcacacttttgatatttatgtctataaatatggatataaaatcgaatatcctgaaatatgaaatatagaattgttcaagctccgtctccaattcagacaccatatatattgttcaataataactytattcttttcttttctttctaataaataaattattatttttaactatgcacaaaaacataatatggttcaaatagctacgaaatattgtagatacgtggttgttctaattcatcgatgtgtacttaaggtactaaatagcatttcatggtagctctaattttgcttccacaaaaaagaaatgcagttatttaggccataaatcatgcattacaattattagttattggctaaataaagagtatatagatcatctactaacgatgttttttgtcctaatattattgttttttttatctcttatcacatttagtgctagaggtgaataggtgagatagaagtgtggtatttcatgtaggacaacgggcgaagttggactcaaaagaaaagtttgaagtcttaaatagactttgatagttcacgaatgaaaattagaaatttgatcctgaattgcatagttaaaactatgcttaaaagtaaaatttgaaatgtgaaacggtagattgtaaacgaagggggtagatttcagctttgatgttaggtaccggaagaagttttgaatatatcagtccatttttcaccataggaaattcagcactgccccgaaagtggaacgggaagagtctcttggcgggttggcacgcagtagggttactgtcgtcaccgttaacgtgcgcgggttcttctagaaggcaggccactttaagttagatttaaaataaatcgttgacgaatcctcccccgttcgcacacgaaagcaggtgaccttctagaaacggtaagtggcccagcccggtccagcaatgcagtgaatcgcgccaggcccagggggggtggcggggcgaggtgtcaggtcttggtagcgactggcaactggaggagcaagcaaagcggcctccctcggcggcgcggctctgaccgtctgtcacgagcccacgaccgggaggcaaccttccccactgcttcgtcccgctcccgtcccaacgcgtcgtcaccccacccctacaaaaaccccaccctccgcctgagcgctctcccatcgtcccaaagcgtggcaagcgcacgccccatcccctccaaggctccaagcctccaacacaacggaatctcgttggtaacccggtgcctgctcggcgttgtggacttgtggtgcggattggtagggggagcaggaggcggcagcagagggaaggaggagggacggcgag

SEQ ID NO: 12886 - DNA, 170 bp, Zea mays
tctgaaaaagaaacaaacaagaaaagtacagaaagctttaaagtcaacttgctgggtcaggaaactggatgactagctaatatatatacacagtagatacatcatcagctcgaatagaaggacaaaatatttagttttctgatatttgttgtagctaaccaaacgtagaa

SEQ ID NO: 12887 - DNA, 394 bp, Zea mays
gtttatgcctatctatagactagtcaatgtttacactaattaagactgatgctgagtgttgaatttatggagtggatataccgctgcttgaggctgcttccgctatgttttgtactgattattttgtgctagtttccatgtactgatgatctctcacagagttgaatacttttttcctagaaagggtctaatgcaggaaacagcagaacctcttgcatgtaggtcggggcctgtaaaggcagtttagcttggtctatgagtggactagttactcactctatcattatatctggatttctgcccattgtttgaacatactttcaggttgtggacaagagaagagaaagagatagctattgtcagtcacagtggtttcttgtttcacaccttaagc

SEQ ID NO: 12888 - DNA, 917 bp, Zea mays
ccattcttatgttgggtttatcaatatttttttatctgtataaataggtaacttcaatcagttgaattaatacattatacaatgaattttaatcccaagactgtctgcaacagtttactaatagtttatcaataaataatgtttgacactgtagactacactattcatagagtgaaatttgaatacaggtatatgtacgaggtagcctaaagacttgttcagttagggatggtcctctccaaaatctactcgaatccccctcaatccatcctaagcaaacaagccctaaagaagttactaagagcgacaattcattttgaagccatgttttttatgctagctgcacagtgcacaaccgcatcgtatgatattgagaagtatataattccctaactaataaccacacctagcatgcatacatagtagtacaacataaaattgttacccaggtgtcgcccattcaggatagatagcaagcaacaagcataggatggcagtggcagtggcagggcatggagctgtccgacgtccggatgcaagtagccggtggacctaacaatttgtgtgccggtgaggtctcccttccaaacagcacagtacagtagagtggtgccgtcgacgcctcccccgcgctattttatgattatcccaaccaagctctaatcatacccccttcacccgcaaaatcccaatacaaatactcgcccagcaaatagatagccagagggacggcggagggaagccaagaaaaccacgccaacgaccaaagcagctgtcgataacacggcgtgctacacctgcttgcctgcctgcctgcacaaccctcagcagggccgcaggcgagagagagagagagaggaagagagacagcgcgaagcggcagcggtagccagcaaaggcggctagagctgttgccc

SEQ ID NO: 12889 - DNA, 56 bp, Zea mays
ctgcattgccgtgttgcatgcgcgtgcactcagcactctggacgcccgagcccgac

SEQ ID NO: 12890 - DNA, 1009 bp, Zea mays
tgtgcctattcatctgacaatttctaaatgtgactgttttgctcctcaataaggtgggttagaaacactattttattttattgaccacatttaacagaaaaccattgttatttcacacccttctgctaaattaatgtttattttctagatgtttctttcatagagttgagaacgtatttttggaacaatgaccgacaccatttcacgttcatgcgtactttttcctttctgtaagattaacagaaactatgttgatctattatgattcaaccatctaattaaytatagaagatatcaagtgtcaactaaatgaatgcaagtggttggtttgtttaacaaaacagattattttttatggaattcatgtttctctattttactatgttcactatttaagtattgtttaattggttgtagctcaacagttaataggagatcatacatattatagaggaattgccaccagcttggattttttagattcttctattcatctttttgtgagcgcagtgccgggagatgcagttcgctgcaatgaagcggggagacctgttggagctctgtcggcagcacggcttcgccacccgcggctccaaatttgtcctcacatgcgcgctcttggtatgacccccaaaacccttgcttttctggcaatcttgtccattgcaggaaacttcagatttccttactgtatctgttttgttatatgaaaaaaaaattaaaaaggtaatattttttttaaaaacaacaaaacccaagccattttcatcttttcgtaaatgaagtcgtgagtaaccgtgtgtggattgtagtctctgtcttcaacacagtccaattgtttgagtgaacgagccagactaagtccctcaagattggtctcatatatgcagtcatgctaatcctgatttacatcatttttgaccaaaatttcttacgcggatttgtttaatgtgtgtaatattgttactgtgtctacaacagaacctctcttgagaatgtgaatggtacc

SEQ ID NO: 12891 - DNA, 322 bp, Zea mays
ccggcctccgcagacggcagacggatcccactggactcggccctctacagggtggcctacccactccggcactccgcgagtccgacccgacggcccgacggctcccagtctcccaccttctccgcctcgtcgtccgacgtccctgctgcataaaactaccacctccaggcctcctaccatttcttcctcgcccggtcgtccccctttcccccgcggccccgccccccatgcccctcgcgtacgcgcccataccgtaccgctcccgaaacactagggcgcggcacgcacccttctcgtgagcgcggggtcgggcgcaggcggc

SEQ ID NO: 12892 - DNA, 1500 bp, Zea mays
gttcagtagaccaccagtgacgatagtgaaacatacctgctactacaacctaccataccttcttgtagacttcacaaaatactatacaggatattctctcgaccaatcgagttgcagcctttactagcctgcgtacaactgcacagtccatgttgtacaactataaagtatgcatcacacatggcaggggtccccaaaaggacacatacatgcttgaagtactcctacagcattggcaaggcaaaggcaaggcacaacgaaacagtgtgaccctcaagcccctgcagtcctgcactgcagcaaagtgctgccctttcgaggcttggcaatcaagcaaggttggccgggtgtcatgtcatcgagtagggaagtaagtgggcatgcactcccattcaccacccccaccaggccaccaccaagaagaaatctataagacgcggtccctctcaccaagtgcggagagttccaaggaaagaggccatggccaggaggtgctgcggtctgtcgacgcctgtaaacagctagctagaccgcgcgctatggccttgagagcggtcgtgtgtgcacagacgggcatgattttgtgaggggtgttataccagcgagcataataaagagggtcactgactggaaggagattaggagaaggactgcattgcagctctggtgaagtgcgagcaagatcttggagaggttgtggcatgtgggactgagggctgtaaacaaggtatgcacctttggttcttcacaccatcttctcgttttgtttctttttttttttctttttcccacactgaaaattaccatgtcccctgctatgatgcactgtaaatatacaaatcatgctaagtttctcagtggctgctgaattgcgcagcactactgtaattttttttacacttctacactgcacaaaaaaaatataagtacagtagaaatgatagcgatgtcgggtaccatgactccatgagtccgtaaaggattaccacacattcaaagttcaactttacagactgttagtgccgtgttcgtgtgctagttattagacagacacaggtcgttccttcagaacaaagcgtcaggctaatttcttattcttgcctcgattactttacgattttccaaggccaaagatttatttattaccccttctacttctaattgtaggtcattccaactttcttgaggaggtaaaacatctcaagtttaagtaaattttatataataaaatactgacgctttgtatatcaaataagtattgttacattatttattattatatttttatagtataactatttgatgtcataaatctatatagttatctctataatttttaactaaacgtaagatgcttgaacttttaaaaaaatggaatgatgaacgaatgatgcaaactttctcactcgtcccgttgttcatggaattacactacaggcctccctccctggcagtgagaaatgttaaaggacggtagcaaggagaaatgttaaggcggag

SEQ ID NO: 12893 - DNA, 1051 bp, Zea mays
aatggccagccaatcttgcgggggcatgattcaattctaagctaaacccattcaactgctgtaaaaaggtctgagccctgcgttgatagaaagagcgctcttttcatgaaactagaaatctcgtaagagaagaagtgagaaatcggatcgacaaagcaccatttcctccgctcaaggaaaatcaatgccgaagactgacaaccaacatcgataggtattacagtgcctctgagttatctcgtactcgcggtttgacctacccaaccagcaactgaagtggaagactgactgactcaggtgttggcttttagctcacctgccagtcaatattcttattagacccgtgtgacaatggtgtttccaacacaaaaagtatggtatactcaagtaaagtactagcttcaccggaaaaacaactgtaactcatgtgtgatcgcggattccacggtaactgtttgttgtagttccagctctacattaggagcataggggctctatctacatacagagtttgacccacggtacggctgaaaaaggtaagccggttaagtgctttaaccatttagtcaaagagactgagcgagtgaattggttttctgttttgtcagcggatcttacgagctttcatagaaagcatactatactatatattttaccgcgtacaaggacaagtggtggcacgacacggaaagtagcatccccataaggatgaattgttggttcaaatcggataatcaatcaatagggaaaaaggaagggattactgtaagatggaatgctcgcgtcggaattcattcttctcgttacggtagcctaagagcattcaagagctcagttagagcctctcaattgatagaggcatgttcatatgaagcgctacgcatatcttattttaccaaaatagggtggggctggtaattgaagatctgggatctatcagtcaaagtggactactaaaaaaaacttctgttgcaaggtaatttttttttaagtctatttagcttcttcgtagaaagaagggatttgctgctttcttagtaacaatattctt

SEQ ID NO: 12894 - DNA, 1500 bp, Zea mays
ctgccctcatggcgcgtgcgcggccaccactctcgtcccttcaacccgctgccacacgcgttgcgcttccgcgctctctagttatctctgctgcagcagcacgaacgccgcgtctgcagctccatgggatagggacggtccaatggcgatcaggctagcaggcagcaggccgtcccctgtcctgtgcattaactccgatcctccgccgtgatcggagagaccaaccacccgatcccacggccgatccgatccgatcagcttgctcgcaatattgttgctagtaccagtgtttacacgtactaagcaccatcattgacccctcagtattgctcccagaacagaactgacactgaggcgtgaggtctgtctgaggtgtgtgattaataaaacagatgatgattatccctaaatcgattccaaagctcccagcctgccaccacgtagtgacgtagttagtggagcctcaacgctccacacacttggttcgcactagcatcggtacgtagttatttttacaggtgttgccgagcgggcgggggcgagtgtcatctcctttcgtttcttttagagttttttctttttggtcgttcgtggtggtggtggcaatagcggtagcggcggacttgcggtcgttgtggctcgccgtacctaaggagggcaaccacttcggttgcggctcgctccctgcggcgaatcattcattagccagtggcgctcgtcgtcccgcgtgccgtccactcgggctcttgatcgaccacccaccctgtccactcgagcgcccctgtttctggcggctggcgccggtggcccggcgggcctgcctctgccctcttggctcttgcggttgcggctgtcatttttttggtggttggagcacgcgcactgctccgggcgtcctgaacaacggacctggacgtggacggcccggccggtgcaccttgtcgctagtcgctacccaagcccaattgcccatcccgcgcgttcaaccaccaccacgccgcaccgcgcgttcaggttcaggattgctgccttgtcttcttccccggtccgcaagaggggaaagagaagttgaggtctgccagcaggcctaccctgctctgtaaaactcatctaaatctgatgtactgccacctgcatgttcatggctagatccggcagcatatagcggcagggtgagatatttctagctactgcagtgtgcagcgcgggaacgtaggacggacggagcaggggtcccgtcgtcatctcacttcgtccctgtcgcgcttaatgctgccattaaactgactgcttgcagctcatccgtgctggcgagctccactaataaatgcgtgcgtatctgtgtgcatcgcggcagccggcagggaagggctggacaggattgcgcgtctgcgcttcagtctccagttcccggtgacgacgcccactagtctctactagataggcagcgccggctgctgctgctgccgccgccgatcagggctttcgcctgccgcccgc

SEQ ID NO: 12895 - DNA, 616 bp, Zea mays
catagccggtcggattgctgtcctatagaatttggctactggagctcaagacaacagaaaaaaatcagaacatcggctactggagctcagtatgctcgaaaattggaatggttcccatctgttcggaaactctagcaaccaacgtccgatcggggatcgctccaatggtcttggttcgttttttcatctcacggttcggcttttgagcaacactggagctgctgtcagaaaggctacctgcatgacaaacaagtagggccaatcccttctggaagactggaacggacgaactgccacagtagactgaacactggcacacagcgccctcggatctgccgctctcgtctcgctcgctcgcgtgcattggccgacaagggacgccacgccggcgtggctgctcacgtgttctcagttcttaccctgcgctctcgccgcccggggcaactggcgagcgagtgtggctgccgcttcctctccgagtcaggcgccatttaataattcagttctacccccaagcccacgcttccgaattcaccgactcctcctccacgccgcgtcgagatcgctcaggccttcgcttccagcaactccaccactcagcccacccgccggagca

SEQ ID NO: 12896 - DNA, 1500 bp, Zea mays
ggtgttgttggaccctcccatgcctctacatgtgccccgtctccatctctatctgcatctgctactgcttgtgagctatcagcttacttggatagcgacgatgtcactgcatatgaggatgagtttgatttacttctacggtgacgtgaccataagctaaccttttcagttctttctataatggctagagacattttctctgtacctgtttctacttaagtcttcagaatcttgttttagcttgacaagtaggattattgaggagaggcgtctaaggttgttgactgaacatgtggagatgcttgcttgcataaaatactgagagttgggtgatagaagactctagcattctgttgacgaccaaaagatggcagaatcctttaccaatttgtattgtgatgttccaaaagatggatctgcgcctccttatggtagcacatctgcaagtgcatatgttgcttctgcttgtactggggctgttgggcattgagagaaacagagctggggcctggggtctggggtctggggctttgcttcttgattctgtaacctgatggttgttgctttttgattatgtaactgggcatatagattgaatagttggcgaggagagctatgttgtactcttttgcgttgtaactttgaacaatactataattatgacttataaaaggattaagaattgtgttgtactcttttttcctttctagagtttttcacaggggtgagttttatccagaaagatttttaatgagatagcattgcacacaactcttaaacctttaatttatcgtgtcttgcttctttggttgtttttttggattttaatctagtttatgtctattttaagatttttcgggggtaaccaggtcacgggctaacctgacacattattgtgagcgtgccaactcgaaccagccggacccgaaaatggcccacaggctcgtgcttgggccataggccaggcacgaagcccaggtcaacccggcaggaaggcacgacgtgccgtgccggcccgaaactatgcgagctatatctaccccgtgctcgggccgtgccgaaccaggccggtcctttgggcacctataattggtctgcaagatattaagttgcatgtatcaatcagttcaatccaaaaccttaagctgataggaggaggtggacaattcacttatattatgttctaacacaaggaataaagatccattgctgtagagcatagattgcgagggcaaggggggcccgggcaatatatatggttacagagcatgctctatatatagtcagtcgtatacaatttacattggtgactcaagctctcaggctcaatcttacaacattttcttttgcgttgcttactagaataggagcgacgaaatgtggtagtacgtcatcaatagtcgtcacacccaccgggctgtgaaggcatgccgacggccgtgctgtagatctgcgccagattagtcgttgtcgtggtggtggtggtagaggggcttggtg

SEQ ID NO: 12897 - DNA, 1500 bp, Zea mays
gaccgctttttaaaataaactaaaagcggtcaataaacagaagttgtttttcctacaagcggcaaacgaattaatgggtgaggagccagaaccaaaccgttttttacatttggagctaaaaaaattggctttttatgtcctcacaaacttcttaaatcgtttttgccaaactattaaaaaaattgtagctcaaaaaatctgcttttaaaaatagccggaacatgccaaactaacccttaatttgctctattttttattgtcctaaatattcattaatggcaaatgaatgaaataattgggcagccagactcttcggccatcggtcaaggttaacgtctcaaatatatggtcaagcagtcaatcaacgggcataactttagtgactaaattttagtcatttttatggttgtttgagatcactttaagttccagctctaatgtgaagctgtaatataatattaatttaaatgattttaaaatatatttaatttaaataataaataaaatgacttacataaatatattataaaggcttacatttctacaattttttgaagcgtctaataacttgctccactaactctaccaaattttctagagttggagctatcccaaacaggaacttagtcttcaaactatcaaaccgtttgactaaataaggtctctaggaattctagagactaaattttagaaagatgactaaagaaaaccaaacaccctaagtagcactccttaggtatcagaaaaaaatgcttctaactttattctaaattaattcatcttaaattttactaaatctataaaaatataaatgatattatataaaaaataattaacattaaatttactataaaacatattataactagagtcataattttgtatgtgttttaaataaatttaataaaatttaaagaagcttaactcctggtctaaacttaaaattgcagttttagggatgaaggttacctctgtatcaggtatttaggtatcacaattcaaaaagagcataccattctagttctgtcctaagacaaattatcatatgcttaactaattttatagcatttatgataccaactggatatacaaatatatcttacgacacttatttgaacgtcactctttaataaatgtttacgatattttaagtagattctcggtttcgtctccaacaaacttcactctgcaaacagtgtggaacagtataaattacagtgccgcattctctattttacacgatccgaagacagtcttaacagtgatagacatgtgatgcggattgtcgtgtggaagatggcacgcggactctcaccaagtcaagagctaaccttatacagaaagcagtggccactgtatatttttttggcaaacaaattcacttgtcactgatggtgcatcaggtcttgtaaatataagcatcaggccaccagctagtacagaacaccaatcacttttccgcgatcgtgtaatcgtgtgccaaggcaagaagcaaccggc

SEQ ID NO: 12898 - DNA, 130 bp, Zea mays
ggtccctaggtggatctgggcgctgcgacgcgtagatctagcggcctgtggccgtgtgagggacatgcgtgggatggatcggcgtcctgatgacctgggtttcgtgtctgctgcaggtgagagggaagag

SEQ ID NO: 12899 - DNA, 225 bp, Zea mays
ctgacatcttgcacaggagcagcaaagagcttgctcctcaattttgggagattacacagcagaaagagagacttctatggggtggaggggctcatcatgctcacggagtcgtggtgtggtacacacttttatgtgcggtcatcctaatggtatggtggacgattgatccattgacagcttctgtttatccattacaggtttgctttgccaaggctttgatcccag

SEQ ID NO: 12900 - DNA, 66 bp, Zea mays
tgcatgcctgcagatggatgaacacaggacgctagcaggcgtgcagacctgaaggctggtgccatc

SEQ ID NO: 12901 - DNA, 1186 bp, Zea mays
gaacccctacctatggtcccggctagtatactgaaaatacatcagcttacttgagctttttatgtctgattgcctgaacgagtccatggttggctatgctgagcacaaaaatattcaagttcatggatcataacatcaacactggactattctaacgtcgcacaactagctggatgcagtcagggccaaaacttagcgatgtatccgctttgaacttgaatcgaatatcaatctgaaacttgaatttcatgcagcactattcttaaggactcatttgattctgtcatgtggattgattgccctccatagattatcatcatgtgttagccactgattttaagcaataatattatttagtttttttaagcaataatatatgccaatggttttctatagcttcatgagcaaaaagctattaataacttctaaatatttaaagcttaacaacaactttttaaaaaaaagttcaaaagttacgtacccttcagtctatctccagcagctctcctattttatttgttattctatcctctgtttgaaattctactctatagctcagtgctatctacagtacaaagcagcgttttgtgtgaccatatacacaatctcgttggaaatagcctcaaacaaaactgctggcccttagaatggcaacgaagctggttgggatgggatccggttggaggggtggattattggagccatgatgcgattcaaacaaaaaaatatatatatgcatgtggtcgtcaaagattaatgccgctagccactgtgaagtgtgtgaagaaatttgcgcaggtgcgtgctgccttaactcccttgagctttcgttcggggtggcaggaatgcagaaactgaaaatggcgtgccttcaattattgtatgtaggccaaccgtgatttaatgtcgtcagctgcgaaccgtatgcggtgcaactgcatgctgcagtctgcacacaacactagtgtttgctgcacccgacagcaaggcctataaaaatgcacgaaccgatggagcgagctgctgcatcggcacgtcaatttactactagcactctatcagtagtgttcagctgctcccgagctagcgagcgaagcactgtcggcacagtaacccccccctgtgcgcgtcgcgtgccgagtgccgcagagcacgagaagctaggccgcacagcaagcttgacatc

SEQ ID NO: 12902 - DNA, 589 bp, Zea mays
actaataattagtaataatacgaggaatgagtttattctaataaatttgtggaatagacttataatacaacactaatctagaatagattaattctttaaaccaaacacctccaaagcgactcagatcctctaagtaggagtaggaatagcgattccttgcgcctcacgcagctaatctcccctcccctcccctcgaaggaagatttctctgtctccttttgcatcctccctcaattagcttttggtctcttctcctttttctttgtttctttctttctgagtcaccagtaacacaaaccttttgtttgtttgtttgtttattaatatgtggccacgaaaaggcatactagtccttgtacatatggggtcatatataaacacacaaggaggggaggggactaaggaagaagcatgatccaagctagcagctcagctctccactccctctctgtgctgtgctgtgtagtcgttcattcatgcacttggcgttcttgcaattgcagcccccttctcctcctcatccttgtcggggcagttagctaggtgagaatagtgcagtggagctcaacaggccagcgataagcaatta

SEQ ID NO: 12903 - DNA, 119 bp, Zea mays
ggtctgtctctccctctacctccattcccccgcgatctcggtttctgttcaattttcgcgctcccttcccctcgcatatgacactctgtgacattgcagaattgaatcactctctgttg

SEQ ID NO: 12904 - DNA, 260 bp, Zea mays
tcttttataatcgagttttatttctatttaattttgaactaaacttagttaaaaaaattaaacaaaattttgaagaaatatttagatcgtgatcacccttatacatgggccacccaaatttctccatcctccggaccatacaaagtcctcgatcaaggcccgtcggcccaaaccaattagcgtctagggtttagcctctccaacccacgtggttttgcttcgacaacgacgctttggcatcgcacacgacgtgagaagaa

SEQ ID NO: 12905 - DNA, 558 bp, Zea mays
cgtgagcccgacacgaagcccgttttttgggcccggtccgaacctggcacggtagaataagcgggcgggcttggacaggaaactaggcacggcgggctagcccggcacggcccgtttacctctaagcccgttaagcccggtttttttacactaaaacgtgcttaccggcccgtttagcccgcttttcggtccgtttttttcgtgctaaataggccggcccggcccgtttaggcccgctgcgggccgggcttggacagaaaattaagcccaccggcacagcaggcccggcccggtttttggccgggcttcaccgggcccgggccgggccgggcggcccgtttggccatctctgcctttattacgcaccttcacataacactgcaaaagcactcctctcttcgtcctccccctccctcctccatcccattccataccattccgccaaagaagaaccacagacgctcgctcccaactcccaagccaagccggatcccaaaatcggcacagcgcacccactccgctcagtcccttcgttcacccccatccatccagccagcc

SEQ ID NO: 12906 - DNA, 398 bp, Zea mays
ggtgtgccagtttgatcccttacccttagtatatacacaataatctttgcaggtggttatgcagtaatagtgccgatgccatagttctaaaccatatttacttataaccaagtaaccatagcggtattggttgtgatcaatgtttatttatttctacgcttctcaaaatttccgttgatataaatcatgcttgggactgttttgtttttttgggttaatactcacatggaatgccagtacatatatatacatgactagacatggtaatataatttatgaggttgcagttatctttgtagttgcgaatgtctgtgagtaagttcaattgtttagctttccttttccatttagaaaagcttgcttggaactattaaaattatttgtattatatcttttct

SEQ ID NO: 12907 - DNA, 1500 bp, Zea mays
gtttaaaaatgaataaaaatagagtccaattctaacccgattcaatccttaaatcatatatgcaaaatttatagtttattgtcagccctagatccaaatcagcccaacaagtatcggcaaggaccaggctttacaatcgtgtcaaagactggcgcagaaagagaaaaagggcctgctgaatttgggcccggcaagaagacgaccatgggtcagctcaatgtgggctcctcgaggtccgatactccgatatcttcgacgaaaaaaatccatctgacacctgtcaagtctcaactatttgtgtcaagtcactcaaccagaaaaccagatttccacactcccttaactttaaccatctgatttacatccttaggtcttattcgttttgttcggaacggatcttctggaattgtttcacctggaatgttaattttatttatattaaaactgatcacctgaaatagttctatgtcctaatcctagctaaccgaacgggcacttaaacagtttcaaaggtggttttggctgatgcggtcttgtcctatatgacaacacgtcagctcaaagtaaatcagatttctgtgataattcagaaggatcaatcaaactttaacaaaaaaatgtcgattatttttttcaaaaaaatattcaaatgcttttctggaacaaatgtacagtttaaaagtactagaatctaatttaatattaggaattcatagaaaacatgttgtagctcagaaaaaatatgaaacaagttctatattcttcttaaagggaaaaagtataaattactcttctcacctaaggacaatattcacataacctctaaagtatttttttaattttattttactcctccactccttcgaattgattcagtttatcatttaacaaaatttgttttttatttattttacgtataaactgaatttcagttcattttttgttggttaataattaatagcactatttagcattaaaaatatgttacgattttttatagatgttttgataggttatagatcatataagataacaagttaataactttaaaggtataaaactaaaaataaaataatgataaaaaacttaccaaaatttttaaatataattaattgtttaaacattataaactttaaatttaacttatacaggaagaaaacaaaaaaaaacaactactcacgagccagtgagccactaatcggacacgccgttttcggaacacacggctacaacaatccagcaaaacactgcccgggtgggccccactttactcacatgtcactctagagacgacagacgacgccataaatccgatcaatccaacgccctataaaatccagccatcacccgcctctgtcccgtcccagctcgaacaggtcacctgagctctgagctccctgctacagtgctaccactgtaccaccagctattgctggcttgctgccatcttcctgtgagcgtgagaagtgagacggctgctaggatcggaataggatcacc

SEQ ID NO: 12908 - DNA, 1500 bp, Zea mays
aactctcatctgttctgttgtgagtgcactttgcacatgtgacatttatagacagttagacactgatgtgttattaaataataaaatgatctgtcttagctatgttatggaatcatatcttgttacgagacaaatgttgccctgttattaaattaacacaatacatataagacaatttgaaagaaattgctgcttcctaaaaactgcatgctgatgcttgatgcaggcaagagagcttttagctaaaaaacgaataacttttgcaaaactccgaaagttgtcgcttgaaaggtgtgccctatgatagcagcttatatgtttgttttgagtttaactttgttatatagcctacaccttccatgtaatccatcagaatcccaaagttcaaaagagcttacacttgttgagcatgtggttgatgtggagtcaccatttattgctcatattttataaggaaaaaatattcttagtatttaccatcgccatagacattcattagtttattaacagactgaactgattttgttcccccctattttttttgtattagaatttttttgaattttgatgcaacacaggtataaagctggttcgataggaggatagaggtaaccgactatatgtccctagtgttaatgccttgggtaatagtggttgtagttattgtgaatggttaattggttactaatgtacctggagaagaagggggggggggacaaatggagagttccgggaaagctcaaaagttccaggaatatctaaacagctgtcttgtatttgaagcaaatgcagcatattcatgagctagtcttataacagctaattggttaattatgcatgtattgaaattgataatttgatatttgtcacatctattccgcaatagtagaccaagctcaaaattgtcttgacttaatcatctgcagatatgtagcttaactttccctagagttatcttaagccaggtcatgcaaacaatttcaacaatcatgtgggagccgccagcactgagtctgttcttttttgtattctcccaagatttatttatttttcttccaggcgtctctagtgtgcaatgaatgcgggttcaaaagaaaataacatgcaattagtaaatttatatgctacaggctattttggacattgaatgtatgtatatgtctggtagaactgctaaggtcacattgcatgtatgtagaaatttgatctaacttgcaattttttagtttacatacttgattggtcaatgtaagataccctactatactttttttccatgatatttcacaatgttgctttattgcagtatatcttcttcagatctggtttcaaagtggatgggtgaaagcgagaaattagtcgcaaatcttttccaaatgggctcgtgaaaatgccccttccattatcttcattgatgaaattgattctttatgcggtcaacgtggagaaggcaatgaaagtgaagcatctaggagaattaagactgaacttcttgtgcaa

SEQ ID NO: 12909 - DNA, 628 bp, Zea mays
caaattccacgaccagtgtcagggcagtctcgaattcccacttacttgctggtaccgtacaagtacaaccagccggcgtctttttttaagcttcaaaacgaagaggaaaatgatacggatcgagaggcatagcacaacggaaagcaacccgaaagcctctacttttccgcccccagcaggccaggactcttcaatcgctcgcgccgtttcttcatcccctcgccatccttccttcgatccagcgttgcctgtcgtcttcgcctgcacggctgcacctaaagctctgacctttttccccactttcccttggcatctactgccttgtccggtgtagaaaacaacggatttcgttgtgttgttttgctgcggtttttgtcccctcccttctcactcggcgagctttgttgttcactttggattccacgggtttgtttcggattaggaaggctcggtttttggtctgggaaggccccccttccgaggcgatgaatttggtgcgggttgatggcgtcctgtcaggagtccgctatgcaatgatgggttctttgaagccgaggtgaatctttgacctgcctagtttgcgattccaaattccgagctcccaccgcttcttgatccgccgggcgcc

SEQ ID NO: 12910 - DNA, 586 bp, Zea mays
aaaagggttttgtttcaacggcaccaaacaggacagaacacaaaagattttggagccgttgggacgagcagagcagcaactggcattgattagccactaaccaccagacgcccccagccgaaacgcccgtacactgggccccgtcacgcagcggaacaacggtcgccgcgagcggggccatgcccttgcagcctcgtactactacccccggcggccggcgctccccggctccttcgctttccatcgccacaggatggctggatcccaatcccacgcgcaccaccagccaggcaacagcaacacccgcgcctaccgccacatgacatgcctgcctccacgtcgccccaccaccacaccaccccgcgcacgagccgagcccgccgcgacgtgcgcgtgccccacccccgcgacccaatataccagccacttttcccttaccgccccaaacgggctagcgtgacgaggtcaccggccataaatccccaacctccgcacactttccatccgccccacactcgtccactcccccagtcacccccgcgcccgtctttgctctgcctctccgcgccgcagagcagagcagagc

SEQ ID NO: 12911 - DNA, 1500 bp, Zea mays
catatcagatctgactctgcaggctttcaacataagaaaagatatacggaaatcttcatagcactgaacaattgatcatcttcactgacaacttctcagataaaaaggaaagtggaaacaaatggattgcccaactaaataactgactttattaataactacaccaagttgcaggggatacccacaccttggtgacaatcattacaaagatccaacttcattacatgttcatcatgacaagcattcaacaaaagatagccaaactaactctaactaagactgactagactaagacactaaattaagcattattacagactccgactccaccgatctatggatctaaatcaatgcgggtcctgcagtctaggataccatagttgaagcgaccacggggcggtgaacagtaagggtgctgaatccctacaggggcgggagaaccaccatcaagatagtggtgtgtcgcgcattcagcacgcagttctacaacctccgcctgaaccttgcccaacttgtcaagggcgtggtccaactttgtgttgagcacggcggccaggttgaccatgctgctcatcctgggattgtcctcaccaactggtgagacaatcacgcctccagcactgccaatcgaacgacgagggtagtacttcaggtcaaggccatcagctaccccgctaaacaacgagcaatactaagaaagtgcccgttgtgctgcatcctgcatggatggctcggcagtgtccctctcagtgatagaatagtgctctgagatggcctctgcaccccggagatcatcatccggacgacgcaccaagcaagttgtgggggacagatatcccccgggtccactagaaggataaaagacctcacgaaaggcccaagggccccataattcgtaaggtcatcccctcgtgggcctgggaggaacgaccagtggaacggattagcacaaggccgggtcggcgcaagcccagacgacccaacaaattcgagcagtaatcgcaacagtgacccgaccttcccgcgcaggggccccgtacatcggaactgagcgaggatgagtcggctgaactataggaagatagactcagttagttcgctattactttggcacacgttgttatcatatccacatgtaatgccccacagtcgagtatataaggcctagggggcaccccttcaagacgatcgacatcattcatcacttagccatccaccccgctctctacgttttccagcactagagaactcccttgtaacccatcgcataaagcattccagccaggacgtagggtgttacgcatctcaaagcggcccgaacctgtacatcattgtctactatttctcgtgcgcccagcacgaaccatcgagctacagtcggtaacaccgtcctactcctaaaagcaccttggggggtaaccctgggtgcgcggtcggacccgaaaacaccgacagctggcgcgccaggtagggggtgtgtcgtcgatccaagctagctca

SEQ ID NO: 12912 - DNA, 290 bp, Zea mays
ttcgtatatatattttatatatatatcatattgtttgtcgtttcgtatttatatttcatacaattttttagttgcgatttttagtcccattgcaacgataggcacatacctaattttaacttatagattcagctgtttctagttttaacatatagattcagctgtttcttgtgtgagaacagaaacagataaagcttttttcaacaatgatcagctgtgcctaaagccgcaagcaccacagccggagaaatcctctcgtgtggtctcttcagctctcagacggcaagacg

SEQ ID NO: 12913 - DNA, 1374 bp, Zea mays
tgtgtcgtcgtcggactttcgatcacacacggtccagacaaaagtcgccagtggcaccgccggcgcgggaaaggggcggacacctggatgacatgtgcaggagactgataacaccgctggctgcccggcgtctcccgatccaattcgaccgcgccatctgcctgcctgcctgctatccttgttttgggtatacaggcggcgctcaggatcacaggagatgatacctggacactttcgtgtctatatgtaggtgccgccaacgcagcgtcggcacagtacgtgcgtgactgcgcacgtacgtgtacggcgcgtcatactgacgttcgtgtggtgctccgctacggagcccaaaacctacgcccgtgatgattgctgcgaacgtcgataagttcggcgacgccggccgtctgccagtacgtacgtacgtacgtactcttttctttgagcagcctgaaacagcaggtatagcgcacgcggaatcgaagcaacctgggtggtggtgacactgacacccccggccgttacgcccgccggccccggacaaattcagctcaacggccaacgcgcagcccgcccggccgcccgcgccgccacgaccacgatgacgacggagccccgcgggctcgccaggtcgctagccctagcgtagcctggcgcggggacgcgcagcccactgcccgcacgacacgtccctttcaccggagccccctctccatcttcccaaccaaccaaccagccagccccgcgcacgcaggaacacgacgccacgcgggcacttttttttaaccttatcccgcctccgccgcgcccaccaaccgggtcggcgctgccaaggtggcagtggcccgacccgaccgcgcgcggcgccgtaataacaaacaagcaccaccacttgctcgcacgacgcaccgcggcacggcaccggtaaaaatcactgcgccggcgccgatatatacgtgcacgcctacgcccaacggcgtactgttgctcccgctttggccggagagaatagaggagcgccggggagagctgcgagcagagacggggcgaaggatagggatcgcgagcgaattcccggcctctctgcccccgcgacagcgacgcgggcggggccgcgcggcacagcgctcgctacctatagagaccccggggggcagactggagagggacaggccgcgtgcgcacgccaccgcgcttcattggccacgccgttgccatcacgccgattaaactagccgatcgatcgcccagctcgcctgcctgtgatcgaccgggtcgctgcctccgatcctcttgctgcccagcaccctggctacttcagccagctagccaggttgagaccgactagctcgatctagctgctgaggcgtggcc

SEQ ID NO: 12914 - DNA, 312 bp, Zea mays
ggtaaaagttgccgcctttcttgcattccactctgttcttggaccggatttcttctccctgcacgaactcgagctcgagctcggctcgggcttctccaacctccaacgcgtagtcccgtctagttttcttacatacaggttattaagctttttttttgtaagccttggtaatttcacttcaagccgtccctagtttcagagaagttcaagtaaatctgagtatatatggtcatatgttctcgcaggtggcattttagtgcttgcttctttcaagaactgcagcgtcttgattactgctttacctctttgcgg

SEQ ID NO: 12915 - DNA, 410 bp, Zea mays
aagaggaaaaaaaggaaaaggatacgaaatcgaacgacgcggcgtacctttttttggcgtggttattatggcgaaggcgaagcgtcgcccgcttctcctgccagaggcgccgcctgtcccgccgcggagttaatgcgacggggcgagtggatggcggggcggccgttgcgcgtgcgcgagccgttcggggaacggctgtttcgctttgcgttttcgaatcccgcgtccggtccgggcggaacgtttgaatctgtctcgccttggtctttatatacccgggagagggtctggtgacggttctttgctccgcttcctgcctccctcttaggttttcgcaacccgagagacttagctagagaagaggaaaccgccctccctgccccttgcgccgccaccccttccgctcggtg

SEQ ID NO: 12916 - DNA, 269 bp, Zea mays
tcggacaatgtatacatgggtacaaatagattgacgggaggcagaacaatcatatgacagttctaggagagacaacctagcccattgcgttgttcatagagaagtgataatgggaggacattcgctcccccagtaagtttttttttctgctccgtttgtcctccaactatttggccgcaaaagcttttttttttctgctccatttgtcctccaactatttcgccgcaaaggcctctagaagcaatcaggcgagcggcggctgcggcgcg

SEQ ID NO: 12917 - DNA, 214 bp, Zea mays
ctatgcgtaaaattgctcaccctgcaccaggtcaaatcctgcgcacgccgagacccgaggcccgtgccgaccctccgcatttcaaattccctcggctttcccttctcccttcgacygatcctccggccaggccagccttcaaacacctcgccgacgccgccgtgcccgtcccggcgcggacgggcgctagaggcaggtaccccgtcctccccgc

SEQ ID NO: 12918 - DNA, 1352 bp, Zea mays
ttgtcggggcatgtgatggcactggtccaaaggccggtggccccaccaaacggaccaagactctgagtcggggtagaccgctcgacagtcaacccatggctacggatagccacaggggtctcgcctagacccaacaggagtgggtaccccatattttgggtaccgatagatgcaattaatgtggcggccctccatgcgagagacctacgttgggtgacgtataacagcttccgtgatatgccttaggccacgtggcagcactgtacctccgtttgagcggagagtaggggctggcagcgtacgcagatgtggcacccccggaccccctggccggaggtccggatggcacacgtagaggtctgggttcgtcccactagggtccagccctggactatagatgtcgagtaatccccctgtcggggaatgtgttggcactggtccaaaggccagtggccttttcggacggtcccagtctctgagtcggggtagactgcttgtcaacccataactacggatagccacatgggtcccgcctagatccagcaagagtggacaccgacaattattaagtatttgaatggttaaattgaaattatctcttcctcttctgtctatgctactagattaaaaggaatatgcatctagcataaaagtttttggatgatcaaagtggctcttagcgagttttagggtttgtagaactagcattggtattagatccatttttatgatccccttttgacccaatgtccatagaacagacgagaagatgtgcaaaataacctttcaaaacttagtaatgtcagggtaacgggaaccaactataaccctaacttcaaccttgactaataaaggagtcaaagaaggaaaagttaagattatatgtgggaagggaaaggggtaaagttcatatgatgtgctagatagattgtgccatgccgttctctgcaattgtttgtcgctattttttcttcccttttgagctggtgaaattggagatgtacggcgctgcagcctgcaggcccttgagctaatgactgtccgctctctgctcttcttctgagattttccgggccagaaatgggaacatcctggttgggttgggctgggcccagccagacggagacggggaactggctgcaccttcacagccagtcaaacctcaaacggacacgcgacgggcgcggccgtgatcgtcatcgcgcaggcggcactttcggagccaccaagggaaggaaagagacgatccgctgatcgccggacgactctcatccgttctccaacaaagcgggctgattggcactcctgctcccaagttccccactcccttccccgaattccggaccgagtcg

SEQ ID NO: 12919 - DNA, 1228 bp, Zea mays
gcgcttttgaaagggaaacttgggctaaccatttcctataattaattttggtggttgatgatcaacacaaacacatagacaaactagtttgtctagaaatcatgttttatacgtgcataaggttcaacacaaaccaataaaattataaagttagggactcaatttcaaaggagcaaaaggacttgagtgtgctgaaggatggcgcaccggactgtccggtgcaccagggtcgtacactccgaaccaaccactctcgggaattcaacggcgcactccgctataattcaccggactgtccggtgtgccactggactgtccggtgagccagcgaagcaacagctatctgcgccaacggtcgactttgacagaaggaatagtgcagcatagtaccgcgcagaagtcagagcagcgaagtcagaggggcaccagactgtccggtgccacaagagaacaaagctccaacggtcgacccagctccgaatcctaacgattgggtgatgtggcggcgcaccggacaaggaatagtgcctgcccgatggcgcaccggactgtccggtgtgctcatcgccagcagcctccccaacagctaccaaagtgtttggaggctataaataccccccaaccaccacaacctttggcatccatgttttttagagatcacattcaatacaagagctagtgcattcactccaagacacatttccaaatatcaaattctctccaagcctagaattcaactcaaacatttagtgacttgtgagagagtgttttcgtgttcttttgcgctcttgtttcttggattgcctttcttctttctcattcttgttcccaagtgacttgtaatcaaagcaagagacacctaagtgtgtggtggtccttgtggggtcttagtgacccgattgattaaggagaaggctcattcagtctaagtgaccgtttgagagagggaaaggttgaaatagacccggtctttgtgatctcctcaacagggactaggttctttggaaccgaacctcagtaaaacaaatcaccgtgtctactcgcttgattcttgtttgatttgtttccccctctctttcggacttgaatttaattctaacgctaacccccgacctcagtgtgtgtttaaagtaataaatttcaggttttgcctattcacccccctctaggcgactttcaattggtattagagccagtgcttcattaagagtataaccaactcgaagtg

SEQ ID NO: 12920 - DNA, 1131 bp, Zea mays
tcctataccaaacaacggaagaaatgatctgagcagagaaaataacctggagatcaaattcttggttcacacgcaactaatatacgaaccaacataagaaagcacactgtgttaatcaaaatgggggaaataaggactacacttgtcatgtgcatgtgatggtggcgaaccggtggtgtagcgtagcgccgacgtgatggcctgatgggtgacgaggaaggttgctgggtcggcgaagctcctgcggggacacagcttgacgatgtagcggctgcgaagggcaagaagacgatgtgttgaggtggatgtggtgtcgtctgttggccgtcagcccgtcacccaccgccaccagcgtatgggtttctgctagtccgccgcccggccgccgcacaagctagggttctggcttttgcttgtcgccttgtccgtccacccgcagacacgctggactaaagacagaagcaggcagatagaagcaggcagaggcatgagtccgtggctctaggggtgtaaacagtatggataatatccgagcatccgattagatttctgctttcgggtacctattgccatctctaagcacacacaacgcaaaggaaatttgaaaaatacgaaatatatacgaagaaaaacagatagggctagcatcttcgcataaggaggcccaacttatgcaatttaatatgggcaggctcaaacacacccggcggcccacttatgcatccaacaggcagcgaaataaaaacctcttgatggtcatttattgcaagagaaaagagtttttcttttggataaacaaaattgaaagcaagaaaaattcttttttattgagaagagttttttaagtctagttgcgaggagtaagttcttttcttatccactcagtttatgcatcctcattacttatttttaaactttactctgtaaataaaaaaacattattttacgtaaactgttggaccccatctactgcacagacacgacgggagcggggaagcctgtcagaagtcagaacaactcgttcgtccgtcaccatagaacgctatcccattcccatcttctgacacaaatattcgcgtgagcgtgacacccgacctccccctcccgctccgggcagcagcagcagcagtc

SEQ ID NO: 12921 - DNA, 505 bp, Zea mays
aaattgtattctggtcttctggagttagcatcaagttcatgtcctttttaaccacgtcgcggtttcaggccattgtagcgatatgtttgtagtctgtaccgggaataacaaccttccgtgattgattatgaatcggttgtcttgggcattattcattattgcaattctcattatttgtagcacttgtttattgagcttaaaggtgtgagctgaagcggttagaagagcacgtctatgctacatggggtttctagatcgtgtaaaataaagagaaaatattttctttatttttttatttgtcatattttagtgtaaaaaaatttaatgagcgacaaatatttaagaacgtagatactattatttataaagagaattttaaaataaaaaagaagcagagaataaattagggagctgtttgagaccggctgacagccacaacagcagctcgtgacccattagtaggggagctgctggagcacacgcacggccacgccccgatatcgcc

SEQ ID NO: 12922 - DNA, 613 bp, Zea mays
attaaatgctaaacaatatcaaagaaaaattaacaataaatatgatttttaatcaaacaagccggttaaacttgaataaaaaaattaaatgaattataaatggaaacagagagagtaagatcctgtctgggctaatttcaactccagaaaatttgatagatttggtggagtaagtcattaggtgctccaaaaaatgataaagctagagctatcaatgtttagaagacatttaaataaattatttcgtttattgtttatattagaagtatttttaaaactatttaaacagctccacactagaagtagaacacgtagccatccaaaacacgccctaattagctaggcaaaggcgaacgtccacgagtgacgtggatgtgggtcccgaactgcctgacccagctgtcagcctccgcgtgttgcatcccacgtcccgcgaagtacgaggagacacgatgatgtgatattcctgaaaagaaaaagaaaagacaggagaataacgaagcaagatctgccgcgggtccattttaactggtcggcgactccgccgctgccatcttccccctctccccctccgtaccactcgtcttcgtctagcctcccgcccgcagccacc

SEQ ID NO: 12923 - DNA, 1500 bp, Zea mays
gtctaatatgaggttctaatcctgtccgttgtaactagtcaacagtataccaagtattcagttttccaactaccagtctcatcttctattgtacttgtgtatttggattgtccggggcggtgaaactgaacagttgaaaatgccttttatcaaaaaatgtagagaagtytagcattgtctggttctgtcatgcagatcactccatacccggtacaagaacagtaagtttgcttcaaaaatttcatgtaagattgacctgtgatttactgacctacctacttttttgctacctgtgcttcagtccaaaccaaaaaatggtcagtttcttgttatttgatgtgacttgttgattatcactgacaaaaaggtctgagcaaggaccagttgatcttttgtaattttctgtttccctgtgattggtccatgcatggttccaagacaacatgaactttttcggtgcatgaaacatgttcaggtacctctccttttcggaatcttttttgtgcattcatctattttggatctcaatctgattccacaatctgaagcttatggagttatggtcctgtcctgtgttgtccacagtttatcttttcctccccatgcggggtcaggtcctgtgttgtccacagtagcagatggtcctgcggcaggaactgggcgtgaatcgtgcatgtgtttcctgcttttccgttctttgcattgcagtaccactatctggcctgtttcctgcttttctttggactggtcacggttgctttcttggatagtgttggtttcatttgcttcgaggcttgtagtttgacagatttatcttgtgagcagaggaggctaattgtcaaaactgcgcctctgaatattgttgtatctagggaaaactgtcgtatgcaaagcaccaagagagacatgtgctagtagtacagtgggctgcagctgttgctgtttatttcctctatagaacagtgattgcatgtgtgcttgctgcaggctgcagcgcaggcttccttttacgtggaccgctcgatgggcctgggcccgttcgagtcggagtttttgtttaaaacgttaaygtgccaaccattacacggagttaggaatgcaaatgcgaagggtacttcgacttagagatggcaacggataaaaacccgctgggtattacttgcccagacctatattcgcgaagaaaaaatatgcccgccaaaaaacccatacccatgacgggtataaaattttgcccaaacccatacccatgcgggtttcgggtacccaacgggtttcccatacccactaacatcaacataaaaaataattcatcatgtaaataacaaccaatatattaataagttaggataaaaggaacaagtgataactaattttagcttaaaatttgttacatgaagtttatttccattaaaacatattcaattaataatattatgagacatatttataaggaatgttgattttaggcgggttttaaaaacccatgggtttgcgggt

SEQ ID NO: 12924 - DNA, 896 bp, Zea mays
ggtaacgggttcagtaaaatgaattttagcgtcctcgcggaccgtccggggtgcacgaccggaccatccgcgactgcctttatctgacatctgacgacgcattaaatgcattatagccgttgatatagccgttggtgctgaccgttgggatttcagccgttgatgtgcaggggtggaccgtccggaccaggggcgcggaccgtccgcggttggcagaattgaagcaacggctaggaagtggttggtggctataaatacaaccccaaccacctccattcaattcaccccaagcattccaaccttccacattcaatacaagagctagcaatccatcccaagacacaatcaaagcttccaatctctccaagttccacaattgagacaagtgatcattagtgattagcgacttgagagagagagagtggtccgtgtgttatttgttgctcttgttgcttggattttgcaatcgtgctttcttctattcccattcttattctcaagtgacttgtaatcaaagcaagagacaccaattgtgtggtgatccttgtggggtctaagtgacccatttgattaaggagaaaagctcactcggtctaattgaccgtttgagagacggaaaggattgaaagagactcggtgtttgtgaccacctcaacggagagtaggtttgcaagaamcgagcctcggtaaaacaaatcaccgtgtcatccgctttcatttgcttgtgatttgttttcaccctctctttcggactcgactttatttctaacgctaaccccggcttgtagttgtgcttaaagtttataaattttagatttgcctattcacccccctctaggcgactttcaattggtatcagagcccagtacttcattagagtctaaccactcgaagtg

SEQ ID NO: 12925 - DNA, 319 bp, Zea mays
aatttataattctatctttctcagttttgactttctattattatgtcatcccatgtttatgaccgaagatatcatctgtgtttataatttatggttccgatgtcatgttagcaaaacacataatgacaaaattgacgatgagcactataatagctatttactccttgattttaacgcagattcgccccagtttctctgaaacgaagtagacagccaccgtcttcccgggccacggcgatcatcaccgccgcggcgccgcccatatcgacagcagagccgctcgcccagtagcctcacctcgcccgcgcttgtggcggcc

SEQ ID NO: 12926 - DNA, 1500 bp, Zea mays
taggaaacgccatggcacgagagtagggagggcgccgaactggaggtcgagcgcaggggctggagcgagccagatgccggtgcactagggagaatgcaagagagaggagagcagagctccggccgggcacgctggcgtggaggaagcctagggacggcgccatggggagctcgacaggatgtgcacagggggacagaagacccggacgcgcggctagcagggcgccgagcagaaagggcgcgtgggggagatgagcttgaggaagcgcgggcggccaggtagaaggagtactgccgccatggaggggagagaagcggcgggagtgagctgcgcgcgggggatgaagcttgcgacgtcttcggcaccacttcgagcgagggcagcgtctccgccatctagcgacgtctttagcaccagatgacttagtcgaactggtccctcggagagcaaatgttggggcgaaggtgaagacgccacccttcgctcgatgccttcgccgtaatcgctggaccaacgaagacaagacaacggacaggctcacccttcgtcccatacatcaccggacaaagacctgtgacgaagtcgtcccatctcgcgctctgtccagcatggaggcccacgtgtgttccggcccattgtaataggccctacgtggccgctgcgcattacgggcctaatttgtaagggcacctctataattacggtctgtaaccccgctttatgggaatattccggggataacctaggtgtctgagggcacatgcgtccttaacacaggacgccgggcactcagatacctataaatacccccgcacagtgcccttgagaggctagattaacagaggtattgccatctcgtgtgagaaccctgtttacgtcactacacacccccgttggattcccttgcaccagagagcaagttccaacaactatagatgtcttggagaaccagcttcacgatgtgcagagggaactcgaagaagcaaatgaccacttggacatgcaccacctggagatggaggccaatgaagcaggaagcgagggagaagaggctcccgaggagctaggaccagcccctggtgccaatgggactacctccgcgatgcctccttcacccgtatccagtgtcgcttccacctcttagggttaagcagtcgcttcgacacttttaggcggatagaaacctatgcgagcttagttaatgtcagattttcgactaggcttatgggtactttcccctgattgatgtaaccctgtgaacttttggaatctgtgggatatttgtcaccatgttatcttcatttcgaacctaatattatgattttggcatttttccttccatatgagctgatatcttgtcgttcgaaactgtgagttgggataacaatggcggcaatctctgttttcagatggcagctatgcagcgtcgcgggcataacgagcaggttcccccgccacctcctccagctctcacagtgcaggagctgatggcccagcaga

SEQ ID NO: 12927 - DNA, 346 bp, Zea mays
ggtatgtctagacataaagatgatgaggacagaccagtgatcgattatgacaaggataatccttccctagcagaaggcaccatattttcatcgatggttgattgtcgaaatacactcgctacttatttcattaacggtgaaatatgactttgaaattgacaagagtgagccaagcaggttgagagtgcactgcacatatgagaggtgtagatggaggatgcatgcttctaagatgtgagatagcacactcattcaggtcaaagtgaacccttttcctcacacatgtccaagtgttgaaagaaaagagactttgaagatagctaagagcaggtggtgcgctgatgta

SEQ ID NO: 12928 - DNA, 629 bp, Zea mays
cttctctcaatcattggtgtctaaaaactggtgtggtcattcttaagctttcgttagtgactcagtgaaaacaggtggaatcggttgagaaaacatgatatgtttttttgtagaagtttggtccctacactaaactttttggattctttttgttgtgaagaaaaaaatgagtagaagcttggtccctgcactaaacttattttaaggcggaatgtcaaaattaaaatgacatctagaatggattttttagggatctgaaacatgtttttataaaaaaaattctaaaaaatatgaagtcaggtgcgaaagagaaaccagacattcacactggtttgaatctttgtgaagccacagccacccactccaaaaccacaaaagcaacatcgactaccaccccatgtccaagttggtcatttccgcccgagctagctaacccctataaatgcccctcccagctcagcgttcgcctcaccaacagaaaacctcgcagctagcagcaagatcttagcacaaacaccacagcccacaggctgattaatcactccaagactaatcaaacgaacgcttagctaatagcgcgcgatcttttttccccctccccctcttgagtcttgagcgtgcgagaagag

SEQ ID NO: 12929 - DNA, 427 bp, Zea mays
ctgcgacggcgcaggcctcaggtcggccgtacgcaggagcagggcgcagtgaatgccagccagagaacgacggcggaaaagaacacaacgaagaacaagaacaaaagagaaaaggagggcagcaaatatttccattcgggtgtgaggaactaacgggaacggagccagaggcacgtcggacatttgatgaatgctaatggcgattaaggatacccaatgccattttttccgttccgatatgattataatgtgctgggaatgggaatagtgggaaaccgaccaaaatgaatgcccgaatgcaaaatctcaccgcgcgggacttacctaaaatgacgggcggtgtcagacctctgaccagaaccagaaccagaacccccccgctgcgcaaccggaggcgtctcccagccccgcgccgccgctgacggag

SEQ ID NO: 12930 - DNA, 709 bp, Zea mays
gggatttgttagagaaggcttgatctatgcctgttggggcccgattcggcgtcccgggatcgattggtgcggttttattgacggggtgggggcaagaggttgcggtggtgttgattcgttggatacggggatttcggggactcgcatgttcgtgggttgatttggccttcgcacttcggttggtggtttctctcggttcttctgtgtggggaaaagaaaacgcgtttcttctctttcttatttttaaagttttaaaaactgtacaatggttgtttatcactttgtcttgtttaaaatcattagatttgtcgttccattttgcctgatttctcaaaaagtttatagcactgttagtagctagtgatttaaatgctctatcatggtggaaatcgtgtgcatctggttgagaacggtggattcgttaaattaacatccctgatttgcctgatttctcaaaaagtgtatagcagatttgatgcacgttgttctcgatttacatccctgagaatcttttttcccttgttttgtagagattcggatttgattatattaccctgattcgtttaaaaggatgggttgagctgtatttgcgcaacatattttgcgacagtgacttctcttcctaaaaattagggtcttgttccgtctaccacgatccattcttgctaagatggcaatgatggtttgatgtgcagacatatattcagtg

SEQ ID NO: 12931 - DNA, 51 bp, Zea mays
atcaagattataagtttcttttattttcatgcaaggttttaacaatggagt

SEQ ID NO: 12932 - DNA, 1500 bp, Zea mays
tccccgcgcacggacacagggctgcccgggcgacgagcatctgcatgactccacagtcgtccacatcaacaaagagacaccgtccgtcgtattactgtgtgagccaagctgcgtgagcgtgaggcagtgagccctgtgtgtccttgtgttcaaactgagaccacacccaaaaaaaaaatccattttaacagcctctgtcacgtacatatcacacgagaaaatgatgtataataaatagagagaaattttgcctctcaacgaacctatatatagaaatcaaacttcattttattaattgttagaggtattattctagcttatacgtagggagtattagatatataaaagatgagacgagacacatgtgctgcagcacatctcctaagatagtagtacttttagagtatagaagagtagataagatatatacggtggagataggattaggcacgtactctacagtctacacacctgtgtatatacggtgtaaaagctcgaatgcacgtactctatatgcaagccaatatatggcaatatccgacggcgacccgggtggctgggtctgacgctttcacgcacgcggccgcctctctgatgccgaaagtccaaagctgacgtgaaaagatccaaatccgtcgcgggaccaccgtgaggtgacctactgttccgttccaaaagcagcgctgattacctgggcgctgcaatagccgccaccatcgtgaccgtccaataccaggtgcagaatatgaaaccggcggagcggatctccgccgtctggatccacaaacccggcggcgacattcctcgttgccttgcctcactcgaagcaaagcccgtattttccttcccttatatataaactattaaaataaaacatctcatcttttgtgcgatgcgacctttcccgtccctcgcagcaccgatcctgccgtccacctgttaataaatcgcctgagtttagtcgaaacacaatcgttaaaatgcagtaaagtaattcacgacccccgggcgcccccgtctccgctcctttattaatatcgccgcggcctcgcacctccatctgttctatatcgccccattgctcgctcgccaagagttcttcttgttaggcaaggcaaaagcagaagcaaaaagagaaaggtaagaacagtctcaggtccctccctcgttcgcattgtctttccatttctctatatgctttgcttgcgcccccgttcgttcgtcagatcgaccacctcctgttctcgtatctgtaacacgagatccggtctgaaccgattttgggcggtcgtccagtctcaatcgaccatgcgaattaaccgattagggtattttattacattaggtgctcagatgatcagatctagtagactatagcgacgccgtgtggcggattccggaaccgggcgcagacggcggatctctttggttatgctgcgatttgctgcttgtctaacacgttgccgactgccgtgtgatgtttggtaggtcttgttgccg

SEQ ID NO: 12933 - DNA, 484 bp, Zea mays
taacccttgccaaaatgtgtgcattagggttcctaacataatatgctctatgagactatgacgcaattgtctgctgatacaacctcgtttattttatggtttagtgcacgtctatatttacttcggaatttactttggtagttaactaatagaagttcatgaatattggagttgtgtaagccgtgtttggtatgatgttcttcatcaggacattgtcccaggcttgcagcagtagtagatttgtctatatttggagtggcgttgattctgatttgtttaatgcttatcttgtggaaagtccagtaaggtcaatttgtaaggagcctgtaactattgtaagggtacagaccaagttactgtcctgtcttttgtgtccctcaaatcgaatgatgtcattttcttggcttccttgattttttttcctgccactctagttttaatttgttattgcttcctttttcaacaatgtcttaggaaaaatgct

SEQ ID NO: 12934 - DNA, 1144 bp, Zea mays
ggtgtgtttggttagctttctcaaccagattcgctgccgaaaatcttgaatcccaaccaaacggcaacagaatagattcctgaaaacctatagatttctctagttcaattcagaatcatctcctcccctagattttccagattcctgtcatctatgttacaagttgccattctcttataaaatctacagttgatatttgtttcaacaaaaaatttaaatttttccacaaccggcagctcacaacagctagaatcaaattatcaggaatgtacaactaaatcaaacgtaccccttagaatgagttagatatcaaatggagttggagctatctaagtagaattcctagtaatatatgttttaagatactaggttacattagtactaccgttgccgtgaagcaaacatgcaaaggattgttacttgtgtcctaaaaaaaggcacaaaaaaatgacattcgtgcccctctactgcctaggttcaccccgattcaactccgacttcgcgagtcgtgtctcacctctatcgccatccgttccctactccacttcaatctgctattcctgctccactccgcttcaatccgccgcccctgctccagtaggaacgttccccaccccggcaaccccccacgctagctactccggagcaccggaacgcaccgtcgcccccgtcaagcaggtctgggttgctcccatcccattgccctagatgggtcgccgcccaccctcactcgtgattcgtggccgtggcaggttgcgccgcccgcccgtggtgccggcgctgtgctggaggcggtggagctggggccgtggggaagcttctcgctggggagagccgggacaagctagagcgacggacatgggtcaccagtaagccacggtcaggggcatttcagtcctacctagcagtggtgatggcaaaaatctaacataatggtaaatttgggatctttgcatatcattccttgtttcttttaaggtcttagatattagacagagtttcattgaaactaagatcagttggttaccccgccacacagattgaagtgttatctgaataggaatgctctggtggatttgcagcaagaaaaaccttggaatgaatgtacaagccacttagggtgctgtattagagctgtaacagg

SEQ ID NO: 12935 - DNA, 662 bp, Zea mays
gttgataatttattttgaaagactgtttttgatacgatcgtacctttttttgtaattatgacaaattaaacatccttttttaaaagataaaagaaacaatcaaacttaaccatctgtatttgacttgactttagagtttgacttgcgtgtttatgggtatgtttattgaatgaaagaatgttcagaatcggatctaaaactatgaagttaaaagtcaaactattatcaccattaaacgatattatagataaattagagttcgaaaatataaaacattagacaaagtagagttaggaacatattgcaggtaaaccaatccattgatgcaaattgtgtaaactaacacataaataaagtcaagacgattttttaaatgttatattttaaaaaactatttcactcactaactatttctaaaacgaccatatcttttcatctacggtctacggtcaagtccgctcggcccagcccactcgtgtgcacggacggacacggaatcacccgagtccgacccagatagcggcgggtttcgaggtccgtcttcctctcgtcactatattaatccctgcctcgccgctttgccttcccygcgtcaaacaaatcttgggttccaagcgagcgaataccttctcgagctaagacgattcgaggcacgagcgaag

SEQ ID NO: 12936 - DNA, 1500 bp, Zea mays
cgcgtccctattagccatattaagggcttgtttgggtgttaggaaaatgaaaagattagagggactaaattttccttcctattcaatttagcccttccattccttttgcttctatacataccctgaaatcagtgacaacataaaatgatgcctcggaaaagttgaggcaacaaaaaaataaattagatgctcaatatagagtgtggcgttggtttttgatgccacaccacactcacggtgtcaccgcgcatgggccatgacaagctacggaccttaatcaaacagccttaggttttatgtatcggcactaactagtcatgaacaatatagattggatgaaaataacttttttagagtatttcagaaatatttctaaaggtcgtcctataagtaataatgttcgggaattcaaacgcgacttttacttagagtgttatttgtataaaaatagttttctacctcttttcactcaacatttttattataccttatttatactctaaagacatatccaacagaccgtgtaaacgaccgtgcaaagtactgttttcactgtagattgcactatttacagagtggagtttgaaatagtgaatgagatagagagcctaccggagatagttgaaggctacctccatcaacattaactcttctatcccatcttttatcccaccttctactccatctgtctcaatatatagcgtaattattactggttcaaagaccaagaaacattttttaattctctctatactattgcattgatctacgtatatacttaggaaaaacacactttataatatggaactagaataaaaagtgattacaccttatatactaggatagagagagtgtctcaaactttactctacaagcaatactatatatagtgcaaaacaatgttgccctttttcaggtgttttaataattttttgtccgtgcaactaaataagttagactacaatttagttccaaaactaaagaaactaaggccctctttagatcaactaattgtttgctagcggaaacaattagctagggtatatttgtagtcttgcttaattagccagaagagatagtaaagaaaccgatgaggatagagagatcgtattttttttctctttttataatctattagtacctattaacatggtcaaatggctaatggacaaataactgtccaatttatagcttgtctgattgaagactaagatgctaaaattatccgacaaatggtttaccagatagatccaaaacaagccctaaacaggaccttattagaacaatgagattattggcatcaaatctcctgtagcctagtataaagtagaaggagcagaagatacggtgagacgctcctttgtgccatactgccatcgcacctcctcgcgtctcgtctcaccgctgggccgggcgccgttaaacatcttgcatccaccagcagtccagcacgtttctctgcgggcgagaagagcagggctgggcgcatccaataccgcg

SEQ ID NO: 12937 - DNA, 281 bp, Zea mays
ggtgaatttgcgaaaaagttgtgctatccctctcagttgtgatgatcagactgttcaggacagttgtaacattttgcagtgcaacccggcttcctttccatgcaactatttggggctgcctgtttcggataagaagttagggaggagggaccttttgcagtgggttgacaagatagctaaccggctgctccggttggaaggctccacttctaaaccttgctggcagggcagccgtggtcagatatgtgctctcagcaatccccgtatatcttttcatcgcc

SEQ ID NO: 12938 - DNA, 1500 bp, Zea mays
agacgtctagcgcccactaggttttgtttatgcttctgttactgatatatatactaggttatgctatactgggtacagtggtattttgctgaccatgtgtactgacagtaaaacaggagctgtcacacagctcacgggttaaaaccatctcttgcattgcactgtgagttggccgtgtaatagttaactggccatgttgttataggctttagaccgagatcgctagactagctatatgaaatagcaacatggacgaacacggtattatattatttgtttattttgacatatagatttttatagtgtacagtttaaaacgaaatgtggagatcgaaaggtcgatgaccttatcctaatgtgacctaatttgtaaagagatactacagaacgacctttttcgtaaaagataaagtacctgcgcagttcatttcgagagaaaaatgcgaattggccaaaaccatactgctacatcgtttgttccttatttaagcacacacctgccatccactttacaatttatttgggacattttctccttcctcctgtgctttgatgcacacacacacacacacaaaaaaaaaagtgttttccatataagttttgattttgtatagctgatttgctgttcattattggccctttcactgattgagttgatgataaagccaccccgaaccaaacttttcctcaaagaacaagcacaaaccaacattaacgtctaagtaaaatgcccatccaataggaacctgccacgtgccccatgttccacaatattggattgtattgtattcccaccaaaaaaaacaaaacaaaaacaaaccgaaggtgtatttgttcgacaggcatcttttttcatcatcggctgcggcgaggcaagcaaaagtggcgaagcctgaaagtgagctctacgatagagggaggggccaaccaaaagcaaagctagcgcctagaggtagctggtagcaggagggctccgaccaatatctgctccaggaccttgttcttgttccctctcgctcatcactgggtgggccgttgtggtggctgcctggctgtggctggtgcgagaaaaaaaggtgaggttttggggatccttggaacaatcatttgtcattccactaacctttccctggtttcttgcattctcgagcctcctttctggcatgttcttggtttagggggggaacggacgattctgctttgtacaatattcccgtatttattcctcctcgattttctgcgttgagatttcctgtctcgtgcccatttccgtccttgttcgcagccaggcacagctgcattaacgctgttgattttctctcgcagtagccagtatcaggcgcaagttgcgattctcgggagttcgttgaggagtcacagagaaagtttggtggtactggtgaggcaaaggtttccttccagggttcgtcaggaacgaggcgtgtcgcaatctgaagcctttcgtgggttccgcctagctgccccccctcggattcggcc

SEQ ID NO: 12939 - DNA, 667 bp, Zea mays
tggaccaaacactaccaaaaacaccgccaacatgggatttaaagcatctaggatgcactaaataatgtgaaagaaaaaaaatatattataggcttttatttggtggcccatctaaaaacccactaattgagcccaaacttaagttccaccagacccacaccacacgtttctttacccaaccttttttcactgatccaccgaaagcacaaccgccgccgtttcttcatctcccatcttcgtcgtcttcgcagcaccggcgctccattttccgctctcggcacgcaggcgacggcggcggcgctcaggcttgggatctcaacgacggagtcagcggtttcccctccccctctcgccagccgcctcgcgccttcgcctccggtcctccgcacaccggctggtgaccctgcgtgcgtgcctctctctctcctcccgccttcggtggatcgtcaacgccgccaggccccggcatctgagccgcgcgcggcctgagggcagcgagagccagcagatgctgctccaccaaggtggtcgcgcatgcccaaagcgaagcgttacccgtcctcttagcgctgaagcgtgcgcttagtgccggcttttggaaccctgtatcataccgaattgcgcattatagaaattggctaggactacactgggtttgccattggcc

SEQ ID NO: 12940 - DNA, 1199 bp, Zea mays
tattacatcatccctgcagcaattgttggatatacatatgtacgcactagttattgtagcatggatgcgatctacttgtttatagaaatacgaaccgaaaagggtcaactgtgtgccacccctatttaaaaacgaagggagtactacagctttttagcgtttgaaaacgaggagctagctggacggtttatttgtggagaagtagttccccccacgcgcgtgtttgattcgaccatcgcggacttgtcaaatttacccggctggctggacgctggtgctggcagggcaggcttgcggcacgaaatcaaacccagcactctctcacactcacggctgccgcgacgaaaacccaccgatgatgatggatccgaacacgtcttccaccggccgtgtgtcgcgcgtccctgtcgacaaaaggcggcactgcgctgttagattaatcgcgagatggtgatggagctaactggttggcaggtcatgtaataatctcgctgctgtcgctgcctcgctttaccgatcacacaacccctcccttctcgttaattttccgttgtccataaactaccagcacaacaacgggcagctaagctaagcttagcacgcaaagctcctcccggccggcgagtgagtgacacaccacacgcctgctttctccaaaacctatccacttctcctatatatgtgtgtctattattaagtgcatgggattcagccgtttagacaacacataatctttgttatcgttgaactatacaataaaaaaatgtggattgtatcttgtaggttgtctttttaactatatcagttgattgcgtacagttatttttcccccctcccaaattatcacccccaagtcccaaccaacccaagtaggggtacagcaacagcaacgcccgctcgctctcccactctccggccggcctataaatcccggggccggactccgagctcacagactaggacacagctaacactcctgtatccgagctactactcctagtcctagtacaggctacagaggcagagcgagcaaaactgcctgtacatagcaaccatcaacgacgaccgatccaagtagtgagcattagtggatctactacgtacatatatagaaggaaacagctgcagctctctctctcgctgtttcctgcgtgatctgcttgtgtagctactagctagctagcggagcggaaccaccc

SEQ ID NO: 12941 - DNA, 371 bp, Zea mays
ggttgcagagctgggccgcggcaggagggcagcgacacgagagcttgctggtggtggttgcagcagaattattgccaactaaataacaggctgcggttacgtcgtacgaagaatgagattaaagaagtatacttcactaatggaacatgcatgaaaatgacgttcgcacaaatgacaattctcttttccgagacagtacgtgacgacccttttctggtgggcaaaatcacgagcagagagagggacacgcgtcaagcctcgcttggcttacaatgcctataaatcacccatgccgcccacgccatctatgcacaagcgtccacagcttccactagagaccgaagtaccgaacagatagagattggagaacc

SEQ ID NO: 12942 - DNA, 1500 bp, Zea mays
gtaaaacacagggatagaaacaaaaaatatacaaatcaagagttgaatgacacttgcattacatagaaaaattttcaataggttggacctcatgttaaaaatcctccaaaatctaactacaatggtccattccatagaagttttacatgatttataaaaacttaatcatttgttctaaaggatagttaaatttttctacatgatttgaatccttcaaaattccttcgtaatttttatttgggatgtaagattgacctcatcagatgacctatcatattatttatatttgaaaatctactatgtccagccgagaaaacagtatgactatttatgtctaacagtggtggccgcctttaacatgtcactggtcagtagcatcaccgttcccgtcggtcgtttgggtggccaaacaggggcttccggcagtcgccactttgaacagaacacgagagcaatggctctgcctgttttcctctctctctctctctagccattgtatctattcaattcacttcactgtagagtgccctaggctccggctccggccggctccaagggtccaccctccttctccgcctctattcagaatctccccaattcactaatcactgctattaagtacgtaattaatctttttcatatttaattagctgataacaatatttattacggtactataaatattatataatttttttaaactttggaaaatgatgtatataaggtaaatagctcagttaataggtaaaggagctgaagctgaataggtaaaggagaatagttgaagaagaagagaaatagagagagaaatgaaagaggggaagtatttagaaatgaatagaagcatgggagatgacagggcgcattgttggaatcagcctgttggccacgcgggccccagccccgactccccgagcaccatcagcaatttcagcagtctaccagtcctccctccgcggccgtctgctacttctgtgatctctcctcctcccccgtctttcgtctccggttgcgtccccgacgtcctcgcctgcggtgagcgactcccgctcccgcccccacgcccaactgaccgcggatctttcggccggccgaaatccccgtccttcttggacgccgctctctcctctcctgttctcgcttccgccgcagcgtgagcccgactgtatggggttaggatagattctttcgggaaaatactctcgaggctccgcggccgcctttcatagctggagacgcacgagcatcggcataaaagctcgcgttttcctatccgggaccccgaaattccgatcctttttcttcggcagggaacagtgcaaaaaggggggagggactgggacattagtttctgcgcctcacctgcttgatcgatctggcgattttaacctctttgtcctttggagaagttcctcatcttcagagtcgtgtcgtggggcgtgctaggtgggagggcggggcggaggagctggaggttcctggtagcggctgccgccggcc

SEQ ID NO: 12943 - DNA, 374 bp, Zea mays
agttcttttctcaaatcagtcctccgcccaaacgattcgttctttcctaagtctggcggtttgttgccgagcaccatagggattggttccatcggcctgtagcgtcacgccgctgccgccatcgcgcttaggtgaggagccctctcctagtcgcctccccaccccctgttcgttaatttggcccagtatgttcttgactatttgttcttctcgtagaatcgctgtcgcctccatggatggtatgcatgctgccatgcatgatgattgatgcattaacgttgcagtggagatcaaggaacggatccaccttgcagccatggccaatgctcacacggacgcacacaatgttgccatagattttgctactcctgttg

SEQ ID NO: 12944 - DNA, 211 bp, Zea mays
gctagcgctagatgcacatgcaccagctgcgacctgcaccggccgcccgcccgccgtataccctctccacctttctagttagatttccacttcttcactagctactactatagctactactctagttgttacgttagctctaccatggcatgcatgtgtgatcgttttcccatttcttctagctctcttccatctggagcgtgtggaatca

SEQ ID NO: 12945 - DNA, 664 bp, Zea mays
ctctcatggacttctccttcatcttccgagttgtcttatagcatctgaccagtttactcttaattggttatttgtgagcaatctgttttttctctatttattcgacgatatcattgtaaatctaacgtgtcatctcttactgtctatctacattactcctacattattatacttgtgttagtttattagcaagcacctctacgcatacgctagtacactagcgatgtcgggccgtgctaatggaaaccgtgatgacgagtgaacatctgcatcaccctccgcacgtgacccgctccactcccctgcacggcactctctctcatcagtcatcgccaccccgaccaccgtcacgcggacctctctcctcttcccctcaaaaccccacgaaatcgccgaaagcaagttgcggccgcagcccgcagtgaacacagccccgcttctctttcccccaacttgttcaatcccccttctcccctcccggagcgcaagagaagctcgcattcctggtggtttctcctcccatcatccgtcctcgatctgagcgttgtctgcttccctgcctccctccctccccttgcccagatggccgccttccgtgtcttctaaatcttccgccgcatcaagcttccctcacctgtcggctgtcctgctgctgctgctgcca

SEQ ID NO: 12946 - DNA, 702 bp, Zea mays
ggcggggcgtgtcttattttctctccggccccgctacaacgtacgcggcgggcgcggttaggtccgcagtccgctacgatacaggatgcgcgcgcatcgatcggaggagagttggggtgctcgggagctcctgttttatcggagtttggtttcgtctcaggtggttcagggtccggattcgtttccgaatggtacacagcagcgagcagccgagcaccagcgatggcgaggcgcggcctaaaccgagtcttgcgcccctccacacgggacgacgtgacacagaggctgctgtctttgtgctctgagctctgaatttactgaactctgatgaaaccaagccgtggccgtggccgtggccgtggtcgtccgtcgtcgactcgccgtgtgactcacgaggccacgacggcatcgcgcacggaactcgggatcacataatacggcccgtagaattttcttggcccgcggaaaccattgaattgatggcccagaacgcacgagcctgctaaacctcctgccctagtctcctctctgtctcacagcacagcccctgctttccccccaccgtcccacggccgccacgccgccacgcttcttcttccctttcccgtccaacctccaaccctgccggctgccgcggcggcggattaacacaataccttggcgagagacgtaatagtttctgaactcaccgcgctacgcccg

SEQ ID NO: 12947 - DNA, 731 bp, Zea mays
ggttamygcttccatacctaatgggttgtagttcaaaaattgaggttccttcctttgttttccttcgtacaatcttgattggctgcttctgttgtaagctaaagtaattgttccatttatgaacaaattgtccctatgcatattctcatgtttttcttttgatttattttagaaaatggtttagagatcgaggaagtcactcgtgagaaagtgaatttcttagaagagcttttgagcagcacataatttgcttaccaattagcggatccgatgacttcagcaaaagcatatgtcatccttgcaaagagcatgataatctttcgcttgcatgggagcttagttcgcagataaggaattgccaaakattgttctctaaaggggcagttagtgggagagcaatcacttgctttagttagtaatttaaaaactttggactccaatcagttatgtatagtagaatcaattgtcagttaacataaacataaggggtcttcccatgacatgatatgttagcatggatgtccatcgaggctgtgatgcactctgcatttgttttattcatgtataactgtaatcatattatagttttttttggaaatgtttgctctatacccgatcatattctaaagccaccattgagtctcaacctgtcttacttaacatttgtagtcacctatctgtgtgtagagctgcactagctgttcttattgtcaggttctgttggtgagaac

SEQ ID NO: 12948 - DNA, 1265 bp, Zea mays
cgtcaacccctcgacactacttcacttttcaattcatcagatagagcattcacaaactttataaacttcccaggtgagcatcgtatagctcgcgtcttagttatacccttattctcatcgccaccaacaataccaacattgtcgtcgccagaaccatcgccggcaggagcaaaatctgggtcttgttcatcatcacttttggcatcttgaataggagacaaggggactttcaaccttaacctcttcctcctttccttcaattcatttttatctaattgctttctcttgttttgtacacgaggagagcgacagacagtatcagcgccttgctggtctgtgacattatgttcttgattcattataaaaaccactgaaaaaatgagaatttaaaaaacatgagggcacaaacacatggtacagatttcataaccaaaaattgctaatcaacaaactaaaacacacagtacaaataggaacaaaaaatagttgtaatacacactaatgctgcaacacacattagtactgggacagaattgccacatgcgacataagccagttgcaacaagactgctaaaataattactactgggacagttgcaacagtgaatttaaacaaataactagttgtataccagccacagccgaaccatttggtcgtgtacgatgccacaaatggtgctcaacagtcgctttaacgaagagaagcgaataacgataggattagagaaacaacactctaaatacagtgtccgattaacactgttatattaaacaatatcgactatacatatcttatgtcccatatcgtctttttcactttccacacattgattagatggtcgactatcggcaaggtgctaaatcatttgctttctgaacacgtgttccgtatgccaccgcgatgaagctgtaaccaactgatgagacctttcctaaccgtggtttacgttggaggccaagtgaccaacccaacagcagggctgttatccaaaaaaaaaaaaaacagcatcagggcggtagcgtaatttccctggccggttgcggccgacgacctcttcgagagaacgaacgattcttcctcccgtttgcttcccctgcccgcactctgcctcgtcaatctcgctccgcgtcccgcttccgctgttgctttcgtcgccatctcgctccggtccccgccgctgctccaagtgggagccaagtcatctctctggccgaagatccaggttgagtcggcgtcgccggcagaggcaagagactccggcgcg

SEQ ID NO: 12949 - DNA, 690 bp, Zea mays
gagtctgagtcgctcttgatcgtgagcacggcttgttgggggtcttcttctccgccgaaggtcttttaggaaaaaacaccttcgacaagacagtacaaaggcaattgggacatgaagatataagtcgaagctacgattgaaaaagcttcggcttggtgtcatgctgaagatgaaggatgataccgacttaaagaggaaaagactgtagagtcctkgatagtctgtattatgatcaaaattagttatcaaggacatggatgtaatttcgtccgggctgcgtcccgtgcccataaatagatgaacaatacccatgtactgttcacgctgcattgtaattgctctcacgtctcttacattaccgccttctgccaagcagaaggtatcagcgaaatataaatattatgagcatttgttcatgtttataaaatgaaatgagaatgtaaataatttatttccatgctgccattatttacattcttgtatgtttcatgtttctttatttatttatatttatttagcaagatgatgaaggtacgcccttcatgacctttgtccaaaaatcattatatcctatgggaaataatgtttcgaaggacaaaggtccttatccattaacaattgtgttgccttgttcagtaatgaccaatattggcgcccacctccggtgaactcacttccacagttgtgacg

SEQ ID NO: 12950 - DNA, 1500 bp, Zea mays
gctagcgaacacaaggtatgtagcagtcacgcgcacgcaatgaagccatacggttactataaaaaaggctgaatgcctgtcaagaactagctagatcgttttttttgttgttgttgagagcaagaacactaaaaacctgatttttatcggctactcctatattttccacacgtcattaaaaaatacaaagagaaactgttttatcaaacaaatttaaaacaactctagctcttccagagaagcaagaaagctagacaaacaagagctggaggtatttcagagcaaccataggcctgccaaaaagggtctaaatttcacttacgggccgtgtcgatgatcgaattgattacgtgtgttggcatacatacatgcgtcatttatgcgtggcaacaaaatttgtccttgacaagaaaaagatgttcggatccatctgctaacgtccaaacggcggccggcgacatatgtcatatgtgcccaatgaagacgcagctgcttcgtttgacgtcattgatgacgttagaccaacttcaaaagaatgtaaactaacctaaaacaaaacagatatcatcagtaaagaatagtgatttttcttgttctcgcattctcttcctaaaaaattagcatccgacgcgttctatccttcctcaatccatctctccgtgtgcattgaggctccacgtttatgtttcccacgcgtacggctggaggggatgcccatacgaagatagcgcaacgctcatacgcaggtgcaaggattggtgctttttgtagtccgtgaacagtgaagacccatacgcaggtgcaaagtgggccgtctggagaacgttttttttaaaaattgagtctagtctttttttttcaaattttgtttaagtagactattggagcatacacaataatttgcctctaaaaatttaaatgttagggacacgacgacgacgacgacgacaatgaaaaacatttaaatgttagggacacgacgacgacaataaaaaccatgaaaacgagtgctttatacagtagatagatagatagataaatgttagggccacgacgacgacgaaaaccataaaaaccgatgctttatatagtatatatatatgttagaagaagcttttaatgcaatacaataatatatttcttttgttttgctcgtaacgtttttagatttatctcaagtgtttatattagtattatatatcaaaagtaattaaaaggtctctattttaaatcttgtcttgtctggaaaaaaagaacgttgtggcatgggctagggctactgaattgaacatgtcgtagatcaaagatgaaccatttctcgttgggtgagatgaagcgctgaaccgtgcagcggcgtgtggataagccgcttgtggacggcacgagcttccggttccgggccaaatacgagagccgggaaccccagaagaatccttggccccgcgcccccagacacgcaccgcacagccacacgcgtacacccgtacaccgtacgcagcc

SEQ ID NO: 12951 - DNA, 1500 bp, Zea mays
attcttattcatatatctttgactatttgcaaaaagactttgaaaaagaatttccaaaaaaacatttgcaaaaacaaaacaagtggtgcaagcgtggtccaaaatattaaaagaaagaaaacaatccatgcatatcttatgaaagtattaattggtttaattccaaacaacctttacacttaccttatgcaaactagttcaattctgcacttatatatttgctttggtttgtgttggcatcaatcaccaaaaagggggagattgaaagggaaataggtcaaaccttttcctaaatgattttggtggttgaattgcccaacacaaataattggactaactagtttgctctagattacatattctacaggtgccaaaggttcaacacaaaccaataaaaagttaaagttagggttcaaaaagaaaggagcaaaaccaaccgaaggctgccctggtccggcgcaccggactgtccggtgcgccaccggacagtgtccggtgcaccagggagatcaactctgaactgctcagcttcgggtttttggagagccactccgctataatttaccggactgtccggtgtagcaccagactgtccgatgtgccatgcggagcaacggccactgtgccaacagtcgtctgcaaaagtgaacagtgcgcggacagcgcgcgcagagtcagagcaacgccagaaggcgcaccggacagtgaacagtgactgtctggtgcggcaccggactgtccggtgccccaatcagtcagagctccaacggtcgaaaccgttagaaccctaacggttgggtgacgtggctggtgcatcggactgtccggtgcgcccatcgacagacagccttcccaacggtcattttgttggttggggctataaataccccccaaccaccacacttcaatgcatccaagttttcaaccatcaaacctcatacaagagctctagacttcattccaagacacaaacaaagagatcaaatcctctaccaagtccggaaccactccaaacaaattagtgactagagagagagacttttgtgttcttttgagctcttgcgcttggatcgattttcttcttcctctattcttgtttccaactcacttgtattcaaagcaagagacaccaagttgtggtggtccttgtagtggactaagtgtcccatttgattgaagagaaaggctcactcggtctaagtgaccgtttgagagagggaaagggttgaaagagacccggtctttgtgaccacctcaacggggagtaggtttgcaagaaccaaacctcggtaaaacaaatcaccgtgtcatccgctcttatccgcttgtgatttgtttttgccctctcttttagactcgattatatttctaacactaaccccgtcttgtagttgtgcttaaactttataaatttcagatttgcctattcacccccctctaggcgactttcaattagtatcagaactcggtacttcattaagagcctaaccgctcgaagtg

SEQ ID NO: 12952 - DNA, 1295 bp, Zea mays
cgagcaccaaatgacactcgataaagactttgttgaatgtccgacaaaaagtactcgacaaagaagccgttgccgatgtatagctcatcgaggcctctttgtgaagagtcacactgataaagagtttgccgagtgtttttcgagctttgccgagtgcttgtggcactcggtaaagtagaccgttccgatagtacatcttaaaaccttagtattctaatattatggttttgaaatactttgttttcaaagacacccagtgtttgatactttagcttctaaactgactaaaatctaaccttttgttttagcctatagatccaaacatgccctacatagatatataaattttactcgtgctttgtaggtcactgcacttgcggcgtctcagggcatataaaacctaatatggggcctctcgagatgtctttaagatgctatttaaaagaaaatataagatacacactcttcaccaagaatccattctatacggttctctatctacctactctcaactgtatttattgttcaaagaattatgattgtattatatagtttttagctatcttttgtacttgcaaaatcgatccatagattaagagcatgtttagaagtagagtattttctttgtttttttaagaatactgtagtatttgacatactgtgatatctttttcaatacagggtttggtagactcttcgaaaactctgttttcaaaacaacggttttggatatgctgtagtagtttcgcaagtttgaaaacttagctctagattaaaattttcaataccgtgggaaaaaaactgcaggtatgttttggtattttaaaactgtagttttggaataatttattttcaaacactgcctaagtgttatgcttgccgtcacacgagtacacgacacgatctccactgcctgcagctgcagctcctgcaagccgcctcgttggccgtgcgccgcgcatggagcctgcctaggcgtgcctgcttgcagacgtcgacgagacgacgacgcatagctaggtcgacgacgcatagctaggtcgacgacgcatcatgtcatgtcatggccgtcgcggccgttccgtctcccaatgcgctgcacccagccgtccgcccctccgtcttcccaatgtcaagattggtgataagtagtttctctccctcggcgcccaaagagtactagtaccagtaccagtggcagtgtgggaacaagaacgagtgatcactgaccagagctcgctgcaggctgcagctggtggttgttttgcctcctgtagtcctgtccgtcgcatgcc

SEQ ID NO: 12953 - DNA, 206 bp, Zea mays
aaaggccttttgtggccatcaaagcggttttaaatatccatcgctcctctccccttcaccacttcccccctcatctctctccgttcattccctctctcatgcgtgcttgggttgggttgggtttgggtatagacagttcttgcagtccacaccacctcaagtgagggggtgaccccccaccctcctccctagcgctcctcaccgcc

SEQ ID NO: 12954 - DNA, 1487 bp, Zea mays
tgtgtagtaaataataataataataataataataataataataataataataataataataataataataataataataataataataataataataataataataataataataaagcatccggtattaggtagctttacttgcctatatatcgtttgtttatggtcaatatgatgttagctgtttgaaacatacaggaagcggtgagccaacgcaattgattcgaaacctggtgtgtctggagtcatatagctagcttcatgggcagtcgtccagcccatacgcatctgcagccgcagtagtgcaaaaaaaaaaaaaaaaaatggaggaggagtgctcaaccggccggccggcgttgtcaatgcaatggcggatgatttgatgtcacggcgatcgataaacaacaaccagtgaatgagcttgtggaaagccatggatagggataagcagctaggcaaaaggcagcatgcatgtttatgcagagggttaattatgttacacgccaaataaaccggggacggtcggcagcggatcgagaggctctcctcctgtgtatagtacaaactagcggacgacaaatattcgagaacagaacacagattggatcgcctcgccgtcttttcagaccatcagatgcgggtagcccatgcatagtttctacttctgcacatgcatactgcagatcagtattcaaaggcatagcgtgtgaaacgaacgagacctcctcctgttctgctggatcgagatgatctgccatataaagctagctagcagaatgttactactacgtactactagagactcgttcttgcatattggctacaagcgtggattggcaggactgtggcgtcggcaattgtgtcactcaaaccgtgtgcttgtcgagagagggagagggagagggagagagtagctagggaacacactctttttgcaagcagaagatcctgacgagtgcatgggtgggtgggggtgctactacgattatattaggccccgtcgtagtgactagctagtactactagtgagatcctcccaaggaaaacaatgatatggttcattagagcgtgttgtggagcctaccaaccgtctcatcagccatcacattcccccgtatttttctcccggtgtccggtggtcgcccgccgtgccccgccgcccgcggctataaagctcggcgccaccttcctggcctgttccggactcgctcgcacccgggcaccagcaggctctccgatccatccatcgcccactactactgctagaccacctgcctgcctgtgcctagctaccacgacgacacacctcatcgccccatatccgcctgcctgccttcccatcacatatatctcccactcgtccttcttgctccggccgacgagatctccatatatacctgctagcgagcgagcgacgacgcgaggcgcgctagctagctagctgttggcttgagatcgatccgtcgactaagctatagctagcagcc

SEQ ID NO: 12955 - DNA, 438 bp, Zea mays
ttttactccatcggtccaggggacccccggggtcgaaacgctgatactaataaactacagacagataaaagaggtcatttaggctcttcgttgatggactaaataaaaatttggaggccattaatttgggacccctgtgaacatgctcagttcgcacgcccttatcgacgagcctgatatagagagtcagagagactttttttcacttaccttacatctcatgaggtcgtttaattaatggagttagacacgccgactcgccgagtgtcccagcaatttggagagaaaaaaactgtccctgcctctgtactcgagtgggcgcagtgaataccctctctcggtccctccaaccgcgctcgtcttatcctcaactcgtcacccacttcccgccatctgccgtccctgcactgcgcttataccctgcaggcaacagcagcg

SEQ ID NO: 12956 - DNA, 89 bp, Zea mays
ggtacctaagacccaagcctaaatgtgccttgcaggtttatgcatccgggggttcaagctggattatcgacagcggatgcacaaaccat

SEQ ID NO: 12957 - DNA, 1500 bp, Zea mays
tgcttcaacatgtgtgtttgacttagagatagagatttgagtttgatttgcaaaaacaaaccaattggtggcaaaagatgatccatatatgccaaaattgaataaaactcaaagtcagtttttatttgaagtgattttgcacttgttctagttgctttatgttgtgttggcataaatcaccaaaaagggggagattgaaagggaaatgtgcccttgggccatttctaagtattttggtgattgagtgcaaacacaagggccttaaatgtgaaaatatgctcatggatgaacaaagtgtaaatcacaagtaaaggtatgtttctaagccttagtacattagttttgtgtactaacatcttgtctaagtgttagaaacaggagaaagaagaaaagaaaagaagtggagagtggctgtgtacagccaaaggctgcttcgggctggggcaccggactgtccggtgtgcaccggacagtgtccggtgcgccagatcagcgcagcgcaaaccagccgctctcgggtttttctccggcgacttcggctaaaattcaccggactgtccggtgtgcaccggactgtccggtgagccaacggtcggccgggccaacggtcggccgcgcgatcggcgcgcgacacgtggccgagccaacggtcggaagggagcaccggactgtccggtgtgcaccggactgtccggtgcgccagatctgcaacggtcggcaacggtcggcttcgctttctatggaaacaaatcgggcaccggacagtgtccggtgtgcaccggactgtccggtgcgccacgagacagaaggcaaagatggccttccagatttgttcccaacggctcctagctgccttggggctataaaagggaccccttggcgcatggaggagaaaaccaagcattccttgagcactcttgatcactcacacatcaatctcgcgcacttgttcgacattctagtgatttgagctccgttctagtgtgctagtcttttgagctcaagtctgggtcttgtgtgtgcgtattcgctgtgatctttgtgttgtgtgtgagttgctaatccctcccttgctccgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgatttcttgtggttattgtgttttgactcctctctagccacttggccataattgtgctaacacttaacaagtttttgtggcttaagttttgaagttttacaggatcacctattcaccccccccccccctctaggtgctctcaattggtatcggagccgttctcttcaagaaagggactaaccgcccgaagag

SEQ ID NO: 12958 - DNA, 89 bp, Zea mays; identical to SEQ ID NO: 12956

SEQ ID NO: 12959 - DNA, 1500 bp, Zea mays
tgttgcaggtaattcccattcattgttcttattgattaacatgctgacacttaagctaatgtgttcagtgttacgaggaacatactccaatagaaatcttcaagtttgaaacagagatttactacaatttgtttaacctgaagatctaacaactctatcaaaacctttgtttcttacatgcctacctgctttacattgtagcctccccatccacccacccacccaccaagagtgaaaaaatctaattccgtcatttttataaaaaatgttatacttttagtgcttcctttgttaagcacctgaagtgacatctttatttcttccaaaaaaattgttgtgttatactcgcaggcccctgttcctctatccatgttttgaacatacttcatttcccggttatacaaaaaaatctttcaatgcattttttggtgaacacgaacatatttacagaaatttgttttaatgagtgttgtcttatgttatttccatgtggcaatacttcagtttttctctttgtcaccaccttaacgtgtactactacagtgtttacaactatagattcgtcaagtattgccctaattaagttacattttaagatattataatcccattaaactgtctaggtttctcttaccaatttaatagttaaagaaattttatgatgcattgtatttgtagaagtaaatgttcgtatgctattcttttaatagccgataaaatttatgcaattaactttaatagtcaagaaaaatgttatgttccattctatcaatagaattaactgtatactgattgtttaaaatcaacaaaatctatctagcatatattcaaatgttttttccatcaaaatctgaaatgtcagtgttacctagatttagcttagcaattggtttagcactctaattatatacctttttctgtcgtagatatatatcttcttcaacgatgttattcactacgggtccacttctagaaggtatgtatctgagaaatattttccccatcgcaaggtaaataatagttatacatctaccaagtttcagatgtagtcttattccttttttagtttttatcgttaatttttattgcactaatgatgtgttacctcttaagatatttgtcaaaccaataattttgaatgacatttatcttggtactttgtcaaatctataaacttgggagttaggatcacatctgttcctataaaccaagttcaaagattgttattttattttgaagatcacaactcactgtaattgttcatgataattatttgtaaactgaaaatccaattatctcgctatcaaacaccttcaaagaaataaattattctcgcgcgcagggcgcgcgttacctactagttctgataaaaaagaatgtgcccctgcgctgcgctgcccaatgtcctccacccgcattccccgttccgctaaaccctagccgcctccggcgcgtagtagattcgccatcagagacgacgctcggcggccctgaggaggg

SEQ ID NO: 12960 - DNA, 57 bp, Zea mays
ctcggcgccggcgcgccctccgggtcccccgccccaccaccactcacatcacatcac

SEQ ID NO: 12961 - DNA, 290 bp, Zea mays
aggatcgttttgcgctgctcttactttcttgtacgtaatccttggattggaatggacggctcgcatgttgtgtgtgtatatatatatggcacaaatgagagcagagcaccagcgtataactaattccttccttttcagttgatctcgccctgtgttctgcaagcacacaccccagccagcatcagtggttcactgctggctgttgatcatcatcatcatcactagtaaatgtagcagttgtgtgtctatgtataaatgtactgaagctcgtgtagcaccctggctcttgg

SEQ ID NO: 12962 - DNA, 366 bp, Zea mays
ggtacgggcaacaacaggttccagcatgtgcgtgagctcccatttctaatctaaaaatcaatgggatagtgataatagtgtccgctgctacccgctagacgtggagcgagagcagctgttcgaaggatcaagcgacgacgacgccgcccacacgccacggaagagaagcacccaggagatcctcaccaaatacaagttcaaaggggtcgcttttcttcttctttctttctttctttctttctgcatcagtctcgccgccaacacactgatccatgtttcgaaaccgcgctcatctttgtgacgatgatgatttacatacaatcgcaggacgccgcggctgccgcggctcacgcgaagcagaagctc

SEQ ID NO: 12963 - DNA, 635 bp, Zea mays
gcaaatttatctgaattctaagtattcgctaaatcaaaaccgtgtcacaattactgtctacattgtatacatcgttaagaaaattgggatccaaaatatctatggtattttggctgacgcttttgcgtgagaaagaaaaagaaaataaaaattcctcaaaaatctcccaaatatctcctagtcatcaatcatcatttcttcacgtaactccacatggcttcctgattttttctgagtcacttccagccgatcctcatcctcccaccgctcactgccgcgggcgggcgtggagatttttcttccgccgctcaattcctgcagagatatccatcgcctagatctcttccctttgccgcggcctctcatttctccctgcgtgcccctggccgatgctcggctccctggctcacctctagtcttctccgtcctcccctctatgcgcgcacagggttggcgtgcgtcactgccctgtctcagctccactgtgcttcgacggctgccatggatgtccggccgctgctttgaccggcgtcctcctcgtcgaccgtcgttcttctccaaaccaggatccacaccagagccaccccagccgtttgccactgccgtgatgcttcctctgctcagagctcccagcc

SEQ ID NO: 12964 - DNA, 1500 bp, Zea mays
cctccctctccttccctgatgaaggaattgattagcttcagatacctcacgtggcccgtcgtccggaccgcaggaagctgccgggccacagctgaggctgccggcacctttgtgcagtcacgcctacgttactggccttctgtttttttttctcttggttcatggcagtaaaatttttacctgcgcctagccgaagccgagcaatttcttcgccgcctcaacgcttgctctgtcttccccgcacagcgcagagtgaaaacgcaaacgcgcgaagctcgtccggccggtaagaaatatattgtgttcgtggaggatggacgtgtgtgttggtgactccagtccatgctcactgctcacgcctggcggtcgtcccgtccaccgctgctagtgcctactccccggctgcacgccgtaccgtaccgacctttttttttataaacatgattcttggctgctagctgctggcgagcgtgccaagtctaccataataatgtctacgctacagtccggcagctacaaaagtagtaccttaggccatatccgcagctaaaaatactgctgtactatactggaaggatacgtcatctcttgtgccttagctacagtgccttagctgcagtaacatatgttgtgtactgtaggcggccatctacatacgtgccaattgttgagatgcccaggcccagcacgggcggcagcgacaaaactttactggtcactgtctagggcatttctcatagacccaaataacctggcaggtcttgtaacgagaatgccagaggcctgagccgggctcgtgatccaagtcgccaccgcacatgaagtcatgagccagctgctgcccagccacactggttcatggtggctgctgtaaacacatgatttttgcacgtttgcagctgctgttctttttttccctggtcgatccgtgacacggtcacactgatgctcgctctcacgcacgcacgcacgcaggcagaatatgctttggttggtgatcaccttcggatcaagcaactccgaaaggccaatcctggcgtgatcacggcggcggtaatccggtcgacgcgcacagagctggagctacagtggtacggagtgaaggttgagagcgtgtgcgcgcgtttcgatccccactcccttgggataggagtaaaagcgcacgagaagcagagcaagagagagagagaaagacatcacggtgtggtgtggaagaagcgaggcgttgggccccgtgattcccttcaactttcgctttctccccctcgggcctcgcctcctctctctctctctctctctctctctctctctctgcgccagtgcgccccacgctgcatcctcaaaaccattctccatcgaatccgtcgcgctcaaagcacgcccttcacagcacagctgcgagtgtgcgtgccaccgccgtgcgagccaagaaacgtgatgccgcgccgcggctaagaatcaggtgtattcttcaggctaacaagcgcgcgagacgacgca

SEQ ID NO: 12965 - DNA, 248 bp, Zea mays
ggtgagttcatgcacattattccccacaacttgttgagcgatgaacatgtgtgagctcacccttgttgtctcacaccccaaccataggagaagagcaggtggtcgaagaggagccgcctaacactgaggctttcgacttgatctaggtggcgtctcccagtcagctttgtggcgccaggggataatatttagttcacttattttatcattaatttttgtaagactttcgctatgtaataagtacatct

SEQ ID NO: 12966 - DNA, 1356 bp, Zea mays
acaggcattgttctacgcatgggcgcaccggacagtccggtgtgccaccggtgcgccatcggtgcgccaacggtcgactccaacggctagttctgacagctagccgttgggcagatggcacaccggacagtgaacagtcactgtccggtgcacaccggacagtctggtgcattgtccggtgcgctatccggtgcgccactaaaattccactcgggaaccttgcgttcttgggtttctgcgttgggaaacccatcccctgaaccagcctggctccacctggtagagggtgcaccagacagtctggtgcacaccggacagtccggtgccccaaggccagaaaccctattttctgttttccgatgtttttcaattcggttttcgttctaacttgtgagtatgttctagagtgtcacctagcactatatgtgagtgtgaatatgcaccaacactacactagaactctcttggtcaaactactcatcgacaacccctctttatagtacggctaaaagagaataaaagacctaactaaatcacgagtttccacatctccttgacactcggactccgtagtccttcaccttttgtttcgttgttttagccgtcgcttcgagttcttatctctgggattgttttcaccgttgtagtacttctacctgtaatgcgacctaacataccatttgtctcggcaaaacatacgttagtcacatataatattacgttgtcattaatcactaaaaccaaccaggggcctagatgctttcaggtacaacctctgcagagtgtaaaactggtatactagccgagctcacggtcacgagcagctcaggactctccgatgattaaattatggaacctaaactcaatttgtcatttgcatctgcatgggatttattattaattttgttctattattatttattatggtttggtatttacttacatctagtaattgctaataaaattttgaccaacttattaaaagcaatgctcagctttaacccctattgttgatcagccttacacatcacatgaactcccacctttggtgagttcatgccacattattccccacaacttgttgagcgatgaacatgtgtgagctcacccttgctgtctcacaccccccacaggagaagaacaggtggttcaagaggtgccacacaacgaggagttcgattcgatctaggtggcgtctcccagttgactttctggcgccaaggatggattttagttcaatccatatttatattttattttgtaagacttccgctatgtaataagtactctgattatattgtgacatttatctctatacactctgttattatatatgttgtcttctttggcgcatgt

SEQ ID NO: 12967 - DNA, 1422 bp, Zea mays
ggtgagtgtcaacaaagaaccacaatgttcgaagaatgtggctaaagcacaaaatcaggcatgtccttagttaagcatgtaacaaaacatagcttccaagaacatgttaacagcatacttctgcaagtttcttcgcttttgtcacttcctagttgtaaaatgttggtacatggtgtaaactaaactgtgtgtcaattggtgctacttggtatttgcagagtgctaagtggaagcaacacttgaagctgacatggagaagaaaaatggaacaacaatccacatgaagcttgtaaaaaagaagttaaactaataatttattctagtgtcaaagttcataatgactggacttgtactctgttattatgctataataatttgttgaatattagatgatcatgtcatgtgctgttttttttacatttttagtgatgtttcattgtgtttttgtttttctaaatatttcctatttttctttgatttttatgattttttgaagaattttgtctccagagaggtttttagccccttgtttgccaaacagtgagtgacaggaaaatacattaaagtgggaaaaatcctcccagggaattaaagtgtcatttaaaatcctcttggtggataatttccctargttttttgtctatttattgccaaattagcccttaatgtagttattcaacgttaaaaacgacggctgattattgatcttttcgctttcacccctaaccaaaggtttatagtttgtataagggcatgtagattcaattgttcagccagaacgtagatcgggaacggagttgctgggccgtcggatgctcacctctgctagtcctctgctgtgtgtgtggtgcggtacaggcattgcacggcccacgcgctctcttacctcgctcgtctcgtcacagtcacagctcaaaagcagcaaggcggctgacaggtgggccgccgaagctcgcgagcgcactagcagagtacaggactacagatgtacaataacaggctcactgctgaaataaagaggagagacatgtaatttcacagctagttttagcacatgaatctataaattttacgagaaagataagttcgattggtcatataatatcaataaagagctaaataacatatagatagactgaaagattgctgcagtacagctgtgatttgaggggcgtgttagttggggttggggcgcgtgtgcgctccatttcacttcaccgttcgagtgggcaaaaagcagaatcctgcctttccaactccaagggggagttgccattcctgtcatccggtgtggcctttgggagagggagagagaaggaaggggaggcttcttccgttccggcagcggctccctccgctttcggttctttgcaagatcgagcgagcgcaatcatcgatcgctgccatcatcaccaggcaagc

SEQ ID NO: 12968 - DNA, 248 bp, Zea mays
gctgttagctcacagtaatccactgactctttaatgattagccattgcgtctcggcgcaaacacggtgccggttgaaaccggtaacatatggtcttcggctataaaacacgccaccggcgtggctcctgcttccccagtattctgctcaagccgagcaccgcagaaaaagaaaaagaaaagccaaaggcaaaggcaaaggaatcccaatcaggcaagcaaaaggaagaaccagctgctgcggccggag

SEQ ID NO: 12969 - DNA, 1421 bp, Zea mays
gttcaaatgaacctggagctccaccaactccatgaagttgggggtgctccaaaaaaaggtggagttgggatgtttaactggctccacccaacttcagtatgtagtttagagttgaatccattccaaacagggcctaaataacacatgactctatgtctaggtctattttgtaatggtttggagctagaaaagaggtgctccaaagtccatgtttaaaatgaactagagctccaaaaaaggtggggttgaggtgtttgattggcttcactcaactccagtctgaagttgtaccaaatataaagtttactttttatttccccatctctcctcttctcaccttcaccttaacatccatgaagttggggtgctctaaaaaaggtggagttgggatgtttaaatggctgcacccaacttcagtatgtagtttggagttgaattcgttccaaaaaatggtctaaataacacacgactctatgtctaggtctattttrtagtggtttggagcgggaaaagaggtgctccaaagtcgaatgtttaaagaaactagagctccaaaaaagatggtgttggagtgtttgattggcctcactccattctgaagctataccaaatataagtctaacttgccacactttgcctaacttttctgcctaaggttagttcttcaatttgaacgattaaacttagtcaaagtgtggcacatttagctatgaaccaaacagcctctaagtttacttttcgtttccccatctggccatctctcctcttctcagcttcacctcaaattgatttaacctgaaccacaagtccacaagtgctccacacttccacgcaagattcgcattaaaattcaaataaaatccatatttatttcaagaaatatataataaacatcgttaaagcaaatcagtgctggattagattgctacggcaaattacatcacatgtccaacaaaaatatctgcaactgtacgacattccatgatctggcgtcccgacccgtcgcgtaaaaaactttgcaataattagtataatgaacagagttaaatcaaaccagcgtcggattggattgcaacggcaaatcgcatcacatgtccaacaaaaaatatctggagctgtactacgttccatgatcaccattcatcatcatcagctagctgctttgattccgaccgctgtttcctatcctttttcattcccacccgcccatcccttcaaaattcgctgcgtgtccctctctctccctgcgctcgtagatccgcccaagcccctttcctccaccgcgggcgcaaaccctaaccctacagccgctcgccccgcggcgcctgccaatggcgccccccgtgtgagtgtgtgtgagaggcagagacctagaggccgctacccggggaggagagggagggagagggagaggctgatag

SEQ ID NO: 12970 - DNA, 825 bp, Zea mays
cgtttttagctgggtgaaatgagttagaaaaatgttacagttttttgttttgcgttacatacataagttcaaattgtattaatatgattgttaccaaaaaaaaaattcttcaattacaatgccacacgttgcatacaagttgaacgttaaaataaaaatgaataaataaggtagttgtgtattgttttgacaatgtagatattgagaaaaaaatagagttatcagactaaacgaaatttagataatgtcgctggacgctggagagagtctctgaaaccaaaaacacaccgcttggttgctggcacgtggcacgggtccctacgcacgtgcgaggccccacgcggaccatcatcctccattcctccagggctgcttcgcggctagctgcccctctcgcagtctcgctgtccatcgactgctgtcgtcaccgactgtagccgaagcctacacggacgaatttcgacgcatttccaaaaaaaaaaaaattgccagggggcaccaattttccttgctgttcctccagctagcgtggcagacgcataaaaaaatatttgcgaaaaagaatcgcactatctacatgacatatgaaggagaagagactagctagggaaggagccgggagcaattccactactcaggccatccacgggacattcctccgctccgcctccgccgccgcccgtccccatccggctccagtaggctcctcgtcgtcgtcctcccccctcgtcgcgccgtcgtcccgagctcgtctggcaagcgcgcgcgcgcggcacgggagacagagtcgctctggcgaggagcgggattgggatccttgcatgc

SEQ ID NO: 12971 - DNA, 604 bp, Zea mays
cactttcaatgcatccaagttttcagccttcacacctcatacaagagctatagcattcaatacaagacacaaccaaagagatcaaatcctctcccaagttcggaatcactccaaacaaattagggactagagagagagagagacatttgtgttcatttgagctcttgcgcttggattgcttttcttcttcattctttcttgtgatcaactcaattgtaaccaaggcaagagacaccaattgtgtggtggcccttgtggggacttagtgtcccgtttgattgagaagagaagctcactcggtctaagtgaccgtttgagagagggaaagggttgaaagagacccggtctttgtgaccacctcaacggggagtaggtttgcaagaaccgaacctcggtaaaacaaatcaccgtgtcatccgccttatttgcttgtgatttgttttcgccctctcttccggactcgtttatatttctaacgctaatcccaacttgtagttgtgtttaaagtttgtaaatttcagattcgccctattcacccccctctaggtgactttcaattggtatcagagcccagtatttcattagagcctaaccgctcgaagtg

SEQ ID NO: 12972 - DNA, 1500 bp, Zea mays
tgggggcgcggggccaaggattcttctggggttcccggctctcgtatttggcccggaaccggaagctcgtgccgtccacaagcggcttatccacacgccgctgcacggttcagcgcttcatctcacccaacgagaaatggttcatctttgatctacgacatgttcaattcagtagccctagcccatgccacaacgttctttttttccagacaagacaagatttaaaatagagaccttttaattacttttgatatataatactaatataaacacttgagataaatctaaaaacgttacgagcaaaacaaaagaaatatattattgtattgcattaaaagcttcttctaacatatatatatactatataaagcatcggtttttatggttttcgtcgtcgtcgtggccctaacatttatctatctatctatctactgtataaagcactcgttttcatggtttttattgtcgtcgtcgtgtccctaacatttaaatgtttttcattgtcgtcgtcgtcgtcgtcgtgtccctaacatttaaatttttagaggcaaattattgtgtatgctccaatagtctacttaaacaaaatttgaaaaaaaaagactagactcaatttttaaaaaaaacgttctccagacggcccactttgcacctgcgtatgggtcttcactgttcacggactacaaaaagcaccaatccttgcacctgcgtatgagcgttgcgctatcttcgtatgggcatcccctccagccgtacgcgtgggaaacataaacgtggagcctcaatgcacacggagagatggattgaggaaggatagaacgcgtcggatgctaattttttaggaagagaatgcgagaacaagaaaaatcactattctttactgatgatatctgttttgttttaggttagtttacattcttttgaagttggtctaacgtcatcaatgacgtcaaacgaagcagctgcgtcttcattgggcacatatgacatatgtcgccggccgccgtttggacgttagcagatggatccgaacatctttttcttgtcaaggacaaattttgttgccacgcataaatgacgcatgtatgtatgccaacacacgtaatcaattcgatcatcgacacggcccgtaagtgaaatttagaccctttttggcaggcctatggttgctctgaaatacctccagctcttgtttgtctagctttcttgcttctctggaagagctagagttgttttaaatttgtttgataaaacagtttctctttgtattttttaatgacgtgtggaaaatataggagtagccgataaaaatcaggtttttagtgttcttgctctcaacaacaacaaaaaaaacgatctagctagttcttgacaggcattcagccttttttatagtaaccgtatggcttcattgcgtgcgcgtgactgctacataccttgtgttcgctagctagcactcttgtttgtccatccatcagcagtagcgcacagttagcaata

SEQ ID NO: 12973 - DNA, 233 bp, Zea mays
cccaaacaccccctccagaccccaagcataacgcccgccgccccgtcctcctcctggggccgccactcctagccgtcgccgttgccctcctcttgggcgtatccaacaacccgttgccccgccgcttcatccgccttctctttggaacaaggccctccattctccgctcctcgccacctcctgacgcagcttacgaagcaaccggcgcggtacgcacaccatgtgttctatgg

SEQ ID NO: 12974 - DNA, 1274 bp, Zea mays
ctgcagtgcagccagatgaaaacctacacatgggacgtgcagtgatctgcgatagcatgaaactcacgcagagcttgcaggccagctaataatgtattaatgccttgactggtcatgggaacggagaaaaggtagctgctttattagctcttgtctaggagtggatgagcgtgccgattagatcaagaagacgagacgttgatgttgaccgaaacctcacgtactcctacgctgtagtactaggaattaaacactggtaggtgaggctgtttcaattcaatgccctcgcagtcgcagctggttaatgcctctgcccgccggcgtctggagtctgccatggctctgggcaacccactaccagggttggccatttacaggattaccctttactgctgtctgcatccctgttgactgtttacgcgttctcttggccacattgctcgcgtagccatatatacacgtttattatatatctatatatattatgtacggtgtccatagtatactactgctgggtgctggccaatgtagacaacatgtagtggctgactgacaactacttgactgctacaggaatccaagcgctcagactcactcttactggagaccactatatggtttacctgtggcacatgcaaactctccaggggcattctcgggcaatgctttgtggccccacatgtcccagcttcatattcggtgctcgacgccgtgtgactctgccagagtgccacctgccacggacacggagggagggaggtgtgccatcagcgcgcagcatcctccagccgatagcctctcactgcctcacttcagcctcggacctgaacagacctcaggaaaggggagacctggaacgaccgtcgagctagagcggctgcgcgctgcgccgagagctggggagtggggactggggaccgaattgaaggcaagaaagtagaaacgaaccaccacaggcggcgcggcaatggatgagcgcggggagaaggaggaggagcacggagtagtggaggaggagacggcggcggttgtgctcaaggaggtggaggtggagatggagatggtcggcggctctgaagaagcctcggcggcgccgctcctcctcgcgcacccgtgctcgctgctgcagctcctgctccgcgcctgcgccggctgcctggtgcgcctgctgcacggccactgcagcgacggcgccaacgacgacccaaaagctgctgccgacgacgacgacgctgcgcctgaagctgctgctgctgcggcggcggcggcgggcg

SEQ ID NO: 12975 - DNA, 967 bp, Zea mays
ctgcagtgcagccagatgaaaacctacacatgggacgtgcagtgatctgcgatagcatgaaactcacgcagagcttgcaggccagctaataatgtattaatgccttgactggtcatgggaacggagaaaaggtagctgctttattagctcttgtctaggagtggatgagcgtgccgattagatcaagaagacgagacgttgatgttgaccgaaacctcacgtactcctacgctgtagtactaggaattaaacactggtaggtgaggctgtttcaattcaatgccctcgcagtcgcagctggttaatgcctctgcccgccggcgtctggagtctgccatggctctgggcaacccactaccagggttggccatttacaggattaccctttactgctgtctgcatccctgttgactgtttacgcgttctcttggccacattgctcgcgtagccatatatacacgtttattatatatctatatatattatgtacggtgtccatagtatactactgctgggtgctggccaatgtagacaacatgtagtggctgactgacaactacttgactgctacaggaatccaagcgctcagactcactcttactggagaccactatatggtttacctgtggcacatgcaaactctccaggggcattctcgggcaatgctttgtggccccacatgtcccagcttcatattcggtgctcgacgccgtgtgactctgccagagtgccacctgccacggacacggagggagggaggtgtgccatcagcgcgcagcatcctccagccgatagcctctcactgcctcacttcagcctcggacctgaacagacctcaggaaaggggagacctggaacgaccgtcgagctagagcggctgcgcgctgcgccgagagctggggagtggggactggggaccgaattgaaggcaagaaagtagaaacgaaccaccacaggcggcgcggca

SEQ ID NO: 12976 - DNA, 1500 bp, Zea mays
agacgaacacaccagcgacataaacaaaaaaaaaacaaattagaatgcaaactgtggggtttgaacccacgaccacatgatttgaagccttgtgctctgccaactgagctagatgggctttgcaattatgtatccaacaacaatgttgataacacaaccgagctcggcgccaagatctgtggcgccgagctcggtgccacgtcgacgccacgcgcccgaggtgtgccaacgcagcacgtacctcggcgccataagctacggcgccgagcaaagggtccaaaaatgacattaaaattttttaaggtctaaacgtgatttttttttccaaaaaatggctaaaatacaaaaaaattcggcgtgtccaccacacttggatcccgggagcccggcaggctcctagtcagcggaaccgatcgatatgatgccgacgttgggcattggattgcgcgaacctgcacggaaacaacgaagcccctcaaaaaatccgattttttttgtccttttcaatttggctgcattgttccgtctcaactctcaagtcacggtttcctactgtttttcgattagtagttgcacgcactggtggcttcctattttgtggtcagctactcatagcaagtataatatgaatggctatgaatggctgtaaggtaggctaaatgcttatgtgcaggaaagagatgagaagagagaagcgggttataaacttacaacggacttaaacacagaaaccaaaaaaatttgtgagatagataagttcgtaaagagctaaatattttataagtgagtaggttgtaatggttcttagactgactccaatagagcgtggaaaatatgaaaggtggaactttatataacactgtgaattttttttgaaataagagacgagaagccttacatcccactgttggttgtattattaaacttgctcctaattgtcttcgcttgaacttttgaatttcttagctttctacactttatataaaacctcacaacaacacaagaagcgaaacattgtgaagcgcactgcatgttctcttaatgcgaggatgccaacacgtcgtcatgaatcataatgaggttgcaccaacggtttattaatttcttcggaagataatttattatcctgtagccgaaaaaagggtgcagatccacaccagagtacgacacgtaaaattgatccactgataccacttagaccatatttctcatcatcctactacattttttgaatgatgcacagtagtattttccaaacatgtatttatgaatgaacgaaaagaatcacacatcaaattaacatgcatctattacctagctactacatacaagtatgaaccctagcttaatttcctgcaaaacatgtattctaaattctgaattgcatccgaaccggctagctagaccgtatgctggtggcttttggtggggagtagtactggtgtcgttgcatcgtcgtcatccgatgccttttggtgcggggtggtgtcgctgtacccg

SEQ ID NO: 12977 - DNA, 69 bp, Zea mays
gctcggtacccatccttcgccgtcgctccacgccactccccgcgcctccggcgcgcgccccggctcgtc

SEQ ID NO: 12978 - DNA, 524 bp, Zea mays
gggtgttgttatgtaagaactctgttcctttctatttcgtgatgaaataggggttgttccacttcgtaaaaaaaaaaaactctgcagccggtcaatgcaagtaggtgggattgcttgtgttgtgtcaattcggacccgcacccgcctaacaaatccagctggtggagtggaggcactgtatctcgtttgttatcccgtacccactctggcctactccactccatccaccaaaagtgcagggccccaaacggccaaacacaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaggcggggcggggggaggaaggaaggaaggagcgccggccggagcagacgtcccctcggggccctcggtcgg

SEQ ID NO: 12979 - DNA, 1500 bp, Zea mays
ctgcaagtgtttctctatatcgcctctgtgtgcagtttgattcagttttcagaaactttgtttagccacttggtaatagtaattttttgtagtttcagtttctgaatgttgtactactattttgatggcgcagcactacaacaacatatattagatttgtggagtgtcactttcatgcaatactaaatatactattaaaataatcattagcttctttaaaatttttgagatattaaggtcgataatgtgttgttcattatgcactaacaatgtcgaacattttttgtgccgtcgcaattgttggtggcacgtggtaccttatgacaggatgaattttggttgcctctgggtttctttctctagaggttgtcttagttgtattgttagcttctgaagtcattacaatgttgttataatttataaaccaactctgcaatgggcactttttgattatgtacatttcctcggtgagtaatttgctacattggtttcctcggtgagtatttgttttttgtgattagcacacgcttcaacacatgaatgctacaaaaaacttagttcatttgattgccttcatagccgatatcattgtgatacaattttaggccaaatgataaaaaattttagggcagctgtgggtgcccaggggctacatgacctttgcggggacggtcctggcatcgcttcagtgtccacctcgacctccaggatggtggcagcggagctcgacggtgttgtgattgaaaagctctcgagactcttccaagtctgtcctggtatttacatattttttctatttctcaaatgtgtagaatatatatttattgtttcattaatataagaggagagaaaaacaaaagtggaagggaaggcactctcccactcaaaaagacacaaccagacaagaaaaaacagaacaacagactagaaattttagaactaaaaatcacataaccacattaagcctggagatctttatcttttgccgagcaccaaagggcacactcatctgcatatgcctataagattgtccagacatttggccttattaaaatcacattcgttctagtgcttccagatttcccatattgctagaatgatgagtgagttgagtcattgactgatttcctttggaaaattgttgcctgcctgctagggttcagctttctagcacaaggcatttaaaaaagttgaaactgagcattactggctgattgggaacttgattttagccatggttgtgtgtttttgtataaaatgagccatgattttgttacaagtgaattacatgatttgtgtatctaactaaaccttgtagttatcatggaagagacactgacttattcttgtgcaagtctagatgccaaccattaggcatgattcaattctagaagatcctgatggtgacatctcacaaccacaacacatcttggactactaccatgtcagtctcaagaatgtgatgataacataaccattcaaattggtgaagtacttcag

SEQ ID NO: 12980 - DNA, 1500 bp, Zea mays
ctagtcatcgggaacgggaaaccgtccgaaaaacgtccaaaaaccgctaacctgaacggctcgtgattttaaattttgaaaaatggtttctgatgtttctcgagcggttttccatagaaaaggaacagcttttcgttgtttctcaccaaatcccggtacacatgtttttaaataaaaaaacaaaatccagcgacaaattgctaagaagccttttttgaccaaatttgttgttaaaaaaacaataatgattgactttttaaaaagggaaatctaaaataatactaaaatctagtcgtttacaatgattttcctgttttttttattttttttatcaaaatttcaaaattttaaatgaaaataaaaaaacacatacggaaactggtcccggatcgaatcgggaatgagaaaaattaccggttatcgttaaatcccaagattttcaactctcaaatttcctgcctaactttccacattttgcctaacttttatgcctaaggttagttattcgattcggacgactaaccttaggcaaactatgacacagttagccacgaaccaaacatgctcttaggccgacactctatccacttaggggtggtaaagtatcacgatccaaataccttttcagaaatatagggtcttaaataagttttagttaaagaatgaatataataaggtctggtcctaatctgatctaatccttaaatcttgtcattcgactctctccgcatgtaattctcaggctacttagattctctccataatcatattgtttttataaccaaattctcagaaaagctcgtcaaaaaaaaatcaaagacagaaccgcttctcttgtgggctgtttggattatattcaggtcatgaacatgagaacatccatgttcttattactaaatggaagcacagttgtagctaccacctgagtagcgcaaatcttacgggagtgtaacttaaagacacctgctacaatacatattttcagtattacaaaatcgaaacagctcaagcaacacttacaaacgacgcgagattaagaggtaaactctgcaggaggtccataatgggacgagcgaactatttttctttctcgtctggaagaatgtccctcacattagccttcttgtatttttcacactatcatagcgaataaagctttacactcacaatacgcatcacacatgtactatagtttaatgcgttgtttgaggcacatttttgaaactagcttaacaaaccgagtcaatgtcaaatgttatttaaaataaacttttttgatttaaagatataagaatttaaacagttttaaatgtgcgtcatcaaactgccacgtgacgtcttctcacgccgcctcgcctttctcttccagctctcgccgtctatcgtcgtcctcttctgcgcccgtacgcccgcctcgaaagtcaaaaccccaggtggcgtgctaaaacccttgcccgcgcggagtacacgagcccgagcctcagcccgctctcctcgtcc

SEQ ID NO: 12981 - DNA, 825 bp, Zea mays
tttggttcctgccaggtcagatatctggcatctcgaatttggcataaacagcactagattggtgcttgaagagatgaggtgtgaggagagaggagagcacgggaggagatagaagcaaatggggaatcggagagggatgaggtgtgtcgagcaggggtataataaaaagctagtggtggaggtttgatggtggaaattgtgtgttttaattgattggagaactggtcctatgtggaaggagtggccaatgtgttgtacacacgacgaggagcatttccacgggtccattcatgttcctttgcagccaacattttggtataaagaaagccatgcataaagctgtctgatgtgaggcaatttactcagttccaagagtatataccggtttgcaaggcaaaacaagctctgtgcaattcattgtcctttttggctcaggcaagccatgcacgaatttgtctagtgtgaggaagtttagtatcaactgacagaacgtatccgctttgccacatagagcaagctaaagaaaacacacaatcatgttgtgctgaaatagataagagcaaaagcatgctatactttggcatgatgagcatccaatgcaccatgtcaaatgaatttgtatcgccctagctcagtgataccagccaaaaattcaaccactcacaacatcatacgtgatatatatataacacgctagcattatccaatctatcgaattactattcatgcagctctaaaaggccttccaccgatctaaatccgaagctaaagcatagaatcaatcaaacacgagtgtcgggggtcgctaaagcttacgcgtcagcg

SEQ ID NO: 12982 - DNA, 1500 bp, Zea mays; identical to SEQ ID NO: 12980

SEQ ID NO: 12983 - DNA, 1143 bp, Zea mays
tcgtggaggaaagcaaggggtgtgtggcgtggccgcgtcgctcgcgcgccgtgtgcaagtagggcctcgcttgagtcgccataaatacagctacggcggacacccacgtgcagcgtgtagaagaaagtggaaggcgtccgatgcttcaaggtcatagcgtgcagtgcgtggtggtgaggccgctgttggccgttcgaagataattggatggtgaattgaagacggagccacgtggatgtcctctgcgtttacttttgctcccgcggttaatatagtaaataaataaataaatgtgtttagaattaagaatcatagtttaaatcttcatgtgtgtataattttagtttttttttatcttttaaatatgtgctaacgacggtaaagagtggtgcttcgagacttgtgactacttttatatgttcacgactgatggtccttccgtggattcctttcgagctgtattggaaagggatgtactctatttggcctgtaactaacctgtgcactgattctatcttgctcctcccgctagacatctctagaacacaagttgttgacaatatctgaggacatggttggagctgctagtgtggtgttgtgttggcagacaggcaggcatgccgcaaggagtcctggaagaaggatgcgtggatcgattgcagcgtcacacgcggcggcaacaagaagaggcaccgacggacgcatcgcgtgcccttctcccctcccctcgtgcgttgacaaaaaagaaagtgaagtgaagaatcaaccaacaatggccggcggaatccaccgaccacaatgctgattttgtttgagccatctggactggactggaccctataaaaaacagatcagatctcccccaccctcgcttccccagcctgcaggttgtcgtcgccctcttcctcctccttcgctgttgctgttgctgttgcttccgcttccgccgccgccgccgcggaaatcaaactaatctggtaacggaaaaatctctcctcttccacttcctcgccacacacaatacttattctgtgtgccattcccctccccttcgtccgggatcttgctacttcttctttgcttagatcgagaccacaccgttccagagagatcccccaaacaaaaaaagagcacgggatcgaa

SEQ ID NO: 12984 - DNA, 833 bp, Zea mays
ctactcccttcgttttttttatttatcgtattttagttaaaaataaactagcggatgataaatattcgagtacggatgaagtattaaattaactgtagaatagagtatcatatcatacagtataattatcaataggacttttatgtacttaattaaatctaacatagtttgatttgtaccaaatctgccacatatgcctagggaaagaatggatatccagtcattcataggctcattccttccggttggacaaggtcaacatcaacgttgatgcaggggattggcgagagacgagacggtgggtaggaggggaccaaatccagaacccgcccacggtattggctcccgcccacagaggcagcggaaacaggggcgtcgctgtacgatttccacaaaaccgggagccctcctccacccaaccgcctggtttccctttgcctttccgtttggctcgcccccacgtttcttccggccttttccaagttccccccgctagcttggcgcggctgccagtccacgtgcgcccgcctccagtttgtaatagaatcctttcctcggacgcggcttcttgcaaaggggggcgggcaggacaggaaccacgcggcgggtggagccgaatccgccttcccccgcctctccaaaaccacaggcgcccaacccactgctctctccggtctccgcttataaaaaccgcacacccactccctccctctccaacaacttgggcgcggccggattcgtataggttagcagcacacagtagcaagctcgcgatctgtgcgcccaccatcaccaccaccgccgggaggagaggaccgaccgaccgaccgaag

SEQ ID NO: 12985 - DNA, 878 bp, Zea mays
atatattgagagtatcatagagaagcatgttaataagagtcccataataacaaaaaactcgtgagacatattcatgcatacataataaagcacatgcccacacttactataaccatggatggtgacctccaccagaagtaatttaaacgcattatacttttctcattagagtagttgtataagactgactcatgaatagcacaacaaataggatccatggtctggaatctccttgcagttggtcgcatgcgtccatcctacaagctagctcctccaagcagggaaaatgtatgtacagagaagcatatgcctcatgtctgcatatttgtttatcaccacatatgtgcatatatcttatgcacatgagtctttaataaatatatgatgcatataaactaataaattttatgaaaatcctaaaaaaattcatacatattcttttcatcttgttatacttatatataaaattttaagctcaaaatcgttatactttagctataataaaaaagataaaattacaagtttaaattagaaaattatctaaaatgttctctttttattacatctaaaatttaacgaatttgaacttataatttcgtatataatagtaggatagaaaaaatatgtatgaaatttttcaaaagttttagtaaactctattagttcatgtatactctatatacaccaaataatcgtatacaccggatatattccctttgtttatatatatagtagacatatatatatactccaggccgaggcagtgcagtcacacacacacgactagcaggcacagcagcaccgactagtcaatctctacttgcctacacagcagaaggaaccagacagggaagtagggaaccagagaaagcatagca

SEQ ID NO: 12986 - DNA, 312 bp, Zea mays
ggtatgaatatacgatacaacgcatgcgcattcaaaccaagatgtgcatgatctagctagctagctaggtagttttacttctctgatctcacagtattgagtagtgacactgacaccatcacaccgacacgacacacatgcataaattaaagagtgctatacactgcggtgccagtgccaccgtaccgcttattgcaagtatgcataaagagtgctattggcagctggtagctcactcgctccaagccaagagatcgtcgtggatcgtctgatgatgtaaacaaaacaacggtggtgtgcgtacgatgtgat

SEQ ID NO: 12987 - DNA, 251 bp, Zea mays
gatccccatcatgacatctgaaagtgttgtagctgaagacgccgccggtgtccagtggtggcggctcgcaggggggcagggcattcaagggccgtcactgcaagaagttctacactgaagagggctgcccctatggtgacacatgcaccttcctgcatgatgagcagtctaaggcacgggagagcgtggccatcagtctctcgcccaccgttggtggtgggggatacaatgctgcctccgccaacggagtg

SEQ ID NO: 12988 - DNA, 1500 bp, Zea mays
cggtccaaccccagggttaagaaggctggggagcaccgggaggataaggagggggaaagttttgtccggtttgggcatggtggtggcctgactccttccggataaccgttaaggttaggacgcacgagtaaggaaagagatccggcattcgggtctcgcgacggtgagatcgcagaaaccggactagtgggtaaagtgtacccctctgcgcagagttaaaacctattcgaatagtccgtgtccactggtatggatgagtctggtatggtatggcaattagagctttttcactaaatttcttaacaaagaaaaggtgtgattaaatgggtgttgaagaagaaaataatgccacgggagcgggaagctcagtggtggttgagtttttggttacttttaagaccatgggaaaaccttcaagcaactgcctctctctaagaaaatgatgagtgactacaactccaccaaattgagcatgtacatcataggtctctttctctctacgggagcggggtgggcttgcggaatacctagtgtattcacccagagttatttatgtttttcaccagccgaggacttcttttctgctatgcttgattaagaggggtgcgtctgcacccagttctgcctgtggcttgggctagtgtactttcctactacgcttctctatttggctctctcgagcttgtaccccggtattgtaataaatttatctaaactctgtactatttgaagtaaggaatgtgtttactagcctcctgggactagtaatggtttcacatttgagtcccaaaggatcgggacgcttcaaaaagggacccctaggcgcatggaggagaacaccaagcattacttgagcattgttgatcactcacacttcattcttgcgcacttgttcgacattcttagggatttgacctccgttctagtgagaacctcgagatattgtcttgagctcaagttttggtcttgtgtgtgcatatttgctgtggatttgagtgtgttgcttccctcccttactcttgtgcttcatattgattcttattgtaagggcgagagactccaagttgtggagattcctcgcaaacgggaaaagagcaaagtaaaaagaacaccgtggtattcaagttgatctttggatcacttgagaggagttgagtgcaactctcatccgttgggacgccacaacgtggagtaggcaagttttgtacttggccgaaccacgggataaatcctcgtgtctcttgtgcttgtccttattgtgtctattgtgcttcacaagagttctcctctctactcacttgatttcatcgttctaactcttaatcaagtttgtggtgttaagtcttaagttttacaggatcacctattcaccccccccctctaggtgctctcaattggtatcagagccgttctcttcaagaaagggactaatcaccgaagagatggatcctaagggaaaggggatggtggtcaacaacaacgagaaggagtctatcttca

SEQ ID NO: 12989 - DNA, 1305 bp, Zea mays
ttctagattctagataaatattgtgttccaaaaagtgctcgtggactttaagagtaagcctcttcattttaatcctgaatgaggcgagacagtcgcccacaactagagagtatgctcaaacaaccacttgtttctggccttccaaatactccacgactttagtatgatgatttccatagcaaaaaagttggtaaattgtccttttaagaggtgaacatcacctctcgggctcgcagagcctgggggctgaacctcaatcattgtctgacaccgtctcacaaagttgcaacaaaaaataggtgttcggaagtctcttctttctgtaggatacaattttcacaagtataggagtccaaggtcatgtttttaatctgtaacctttgtttcgtgttgagcttgtcatacagttgtagcctaaagaaaccttgtgcttcggttggcatttagatgtccatgtacaagtaatggtgcggtgagagactgattgaccaaagagacacgcataaagcttctaagaagaggaggaccgtagaagtaaatccaagtgtcattgctaagggtatcctcgatcagatattgaaagtcatactggagcatgaggaattattaaaaggcttgaatagaggtgttctaggttcattgccatttgaattgtggctctagcattaacagcaaaagaaagaaatccagcgtaaacagcagcaaggtgttctcgcccctagatgtcgaacygtagagaaatcgatcagccatcgaatacgttgaccctgaagtcagatttgtacgtaggtagcaatttgagcacatctctccaccaaaacgaacacgtcatcttgaaagcagacagtccccctaatgatagtgattatttcaaataaggtccacccaagggggtcaagtatgtagtcgaacttgtgaatgaatttcatgagaaagttctagttgtgtagtcccagatcgatgacccccagcccctcaaggattttggtctggtgatcaaatcaatgaccaggtggcaaggactgtgtgagacccagcgccttgaaaattatttacgcacgcaggagagctgtgcccacgcttttgatgttacgtgcccccggcgaaacgtcccacagaaattggacacccatcttcttcgtgtggagtgtgcggagagccgcgccgtgtgtgtgcgtccatttgtgtatccacggaccgcagaagaacctcaaaagctcttcacttttcccctccactccacagcgcaggcgaggcaggcacacgcaagctgccgcatttcttgcagttgcacctcgcaaacag

SEQ ID NO: 12990 - DNA, 557 bp, Zea mays
gccgtcgctgccgcctgcgctaggtgccaggtcttcttcgggcccttcgccggcgacgagtaccaccaggtacaccctcgatcaccttggtcgtcccatcctgttgtgttgtgcgaaaccatgcacccaaaccctaacttagtatttgtattcggatctgacctgtatatgcatgtattatgcatactaacttcgattgcttttctaaatttataggttgtacatgtatacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacaagggtctttatacaaccttaccctcgatgaggtgcagaaccatttgggggagccattgcttagc

SEQ ID NO: 12991 - DNA, 413 bp, Zea mays
gccgtcgctgccgcctgcgctaggtgccaggtcttcttcgggcccttcgccggcgacgagtaccaccaggtacaccctcgatcaccttggtcgtcccatcctgttgtgttgtgcgaaaccatgcacccaaaccctaacttagtatttgtattcggatctgacctgtatatgcatgtattatgcatactaacttcgattgcttttctaaatttataggttgtacatgtatacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggca

SEQ ID NO: 12992 - DNA, 830 bp, Zea mays
gtagtagtgttgccaataccgtgagcctggtgcagtggtggtgatccaaacttgtgtgggtgtaattactggagtagaacctaacaaagtgaaggcatttctgacttcttggggggctccgcgtcctcttggtacaactagtgtattgatagtcttgggaaatgaaggttctgatcgcatatctgttgttgtaatagttcaatgtataagcatgtaataagtgatataatgttcacattgctttggttgacacaagtgtgtaacatgtgctaccacaagtgattctgggcgtcctttgtagttgaaccatatttgttttatgatcctgcttttctgtatcatctgcctgcttttgttagcagatgtacggaatcttctgtacttggagtttatacctaacaacatacttatatatttatattacaaacctgtctgatacagcttcatgagctattggaagctgtggagctctctttttcaaaacagttttatagatgaagctcttcatttacgcttgtacaaaggaatgaagagaggtagttgaaaaaaagcaacttttttacatctctgtcttatttttatctttcagccatgcatgaaattgttggtgaagctgttttgcaaaatatttttttcccaaaacagtttaaattcatcttagaaagctactcaacagcttcatggatgaaactgatgagattttgcaaacgggtcctacacattcgaaatatctaaatgagcggtcaagcatggtttctttggacgatgttgaagacttggatcagaaacgccatccgggacaccgtgaccaggtccggcggcgaagcgag

SEQ ID NO: 12993 - DNA, 1307 bp, Zea mays
atatatatataatatatagtcatgtactcttagccggcatataagttttaccttatctctagtttgtagacgagatggatgaaggaaacatcttatacgagacgccggacgactattaaaattagtgatttatattagtagagataaaggttgggaaaaccaaaaataacagaagaggccgtggtaggtttcatctcaaaatatgtgatcattatttgcagcattaatatctgattaggactagctaaaattatacaccactactatacgatcaattattaagcatgccgtccgcgtctaccagcctagcctgtagctgcagctgggtacagtcccagcgtacagctagcaagctcccttccccagaacaaactggaataaaagcagcatgggaggaaggatggtgaccatcaaatggaaaaaaattaataaaaaaacacaaagaaaaaactgcataaaagtgtctgaattttagataatttgagtcaacacgcatgtataacctaattagtatgaaatgttgcttttatgatttgtctttgtattataacaaatcatttttttttgtctttgcttaactatacaaatattttttttattattatcgtgccaacacgtaattagatttgttaggtttataatgttgtcttataaattctttattctcgaaactacaaattacagactatatctatataaaatacaataaatcgtatatgtaattttagtattaaaaatatataataactattatctgaaaaaaactaaaatccatatacctgaatttagcaaaatcccaacggaaataggacaacgggcactcaagtgaagcgcacctacctacctacctacctacacctaccaaatacaggcagcgcccctcccctcctctcccctcgctgcggctctgcttcgcagccaaccaaccactcgaccgggtggtccacctcccaccccatcacaccaccacaccaactcggtcaaatgcatgggcacggggccatggctcactcacagggatccgggtcaatggggcgggcaccctcggccctcgctcctccacgctctccacctcgacccctctttcgtataaaaccaaccactcctcccccgctcctccccggctccttgcctttgttctgttctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggc

SEQ ID NO: 12994 - DNA, 799 bp, Zea mays
ttgcctctcctctctctcctaggctctccgccgttctcctctcagccgtcgccgtcgccgacgctctcctctctctgtccctctcctccacaccgctctcctctctcatccaagccgcagctcttctctctccctctcccttgcgcgccgccactgcgggcatctacaccgctgccgctcctctcttctccgagccgcagctcttctctctcctcccctgcgcgccgccgctgcgggcaccctgcacgccgccgctgcgtggccctgcacgccgccgctacgggtgccctacgcgccgcggtcactgctccagctctcctctgtttcccagccaatgccgccgctctaactccccaaggcatcgccccgacgacggctcaacgacgccccgtcgacgcctcgcggacgccctgcgccgcagcgggcgctttacgctccatggcaaggcgcgttagatgcctcaggttccacgcgcgccttagcccctaagcgacgctaaggcggcgcttcaaggacgccttgataagcatgattgggaggttatctatgcttatagcttttgctctggggttagtgttgttgaattggaatgaatatgtgtggtagtggtactgtggaccgtggaggatagctgagcatgcttttactatcttttagtttcaattttatcatatgccaaaagtgttggtttccttgttttatctttaatctttcattggcaattggaatctctgtctgtaacacccttttattcctggtaaaataactctaattttatgctttttcatcaggtgaaaac

SEQ ID NO: 12995 - DNA, 592 bp, Zea mays
actgatatacacatgattcatgtagggggcaaaattttttgccaacaatatataaaatataaaatacatgaaaagagagtccacgatttcagtgcacccctcacgacgtcacgcgtgcacctgtacagcgcgcgcacgccgacaccgaacgaatatcggggcccttgtacacttctacgcttggatgcctgagaatctccaggttcagacccgttcagttcacagacaccgttcagccgttgcggcgttgccgttgcagcagccagcagcgctcgccagtggacgaccagtgcgccacgcgcaggtcgcaggtcagtgctacccgaggcccgtggggtcgatcggcccttgtctctgtttcatcactgccgtaatgccgtgctcgtgctcgtgctcgcgaggtacctcgctctctcctgacttcccgcgtctgcgttgccggtctgctcgtataagaaccgacatccgacacgccgccttcgcactcgtcaacctctgcgctttgcctgcctccctcgcgttcgcgttccctcccgcctccagatcttgatgcggtagcggcttccatgacatcggaggcgatctcggcacc

SEQ ID NO: 12996 - DNA, 833 bp, Zea mays
aacatccagttccagaagaagttgcaggcgtgtagctgcagcctgcaggtgcctgcttcagtacagattctactccctttgccttgcgattcgatggttttgagatttaattaattctatgtcgtgcggcagctcgtcgtgatatacgtggatttcaagctcgaagaagtgctccactaaaaatgaaacgttagaattcagctgagcatcttactctacattgcagcaaactgtgacgtgctttgctgagttagattagtctggcatgcttgagtttcccatggtaaaattatcattcatttgcattgtacttctatttttttaaagaactttgccatttgttcataccaaaccggtctattttatgtgtctactttgaatcgcactaaattaagtttattaatgcattcggctaatgtaggtagggcgccgcgaagcgcgcctctttttctagtaaacaaaagcgcaaatggaagccgcttcacgtagcagcccgtgcaaagcaagcgaaagggacccgcgagcagcgaagcaaccaggccaagcgcaacacgacctacaccgtggggccggccatccaggagacacgcgtattccgtcctggacaaaggaccgcatccacttgctagctcgctagtcattacctgatttcgccgcgggcgtcgtcgtctttctccttcctcgtcctttataaaggaaggtggcaatggcctttccctctgcaccgccaagttagcttgcctagccacatcaaagcaaagctagctacggccagctttggcgatctgcttgcttctctctgagcgtttctttacaactaaaccaactgagca

SEQ ID NO: 12997 - DNA, 664 bp, Zea mays
ggaagagccggttaaagtggcataacaaagtcaaacgaattgtaatttgggacgaagtgagtatttgatatgacagggactaaactttatccgttggaatcaaacaccctttatatcttgtatagtattcaatgtggcaattttggatattgtgttaagaaataaggtgttgtgaatagccttagaggtaccctacactgaatatgatctgtcactgcaaaattgctgcagtcgactaactactaattatcatggccgtagcactgataccctcagtgatcatatcaacggcaactgatggcttcaatgtcttgatgcccagggccagtaacactgatacgaccattcatggcatcttttgatgcatgggtgtttttggtagcaactttcatcttacaagtcctggcatccaggtttacgcatgcagactccttattttagccaacgcaagagcacgaacaaacagaggaatttcaccttggcccttcctcgtcgatcaacgcgaatccgtctccgtccgtacagaagagttgcctgtgaatctgtgattgaggacgaaccatgcgtcgtccatcgatcatgaggcggcgtctccaacggagctaaggagatcggtcggtgagcggtggattgaagaatcgggagctagcgaggagggaggagg

SEQ ID NO: 12998 - DNA, 1422 bp, Zea mays
accataggtacatgtcactgacactagctcctgacccttcttacgatttggaaaattggttcgagggtttctattgatcgatatcccaaatgttaacacccttttactagtgtatcccatctagtttatcctcttcaatgcatgtgtcatgcatacctattgacaatttagatatatcccgatgatggtatactaaaggacctagatagctagagggcgatgaatagcctctaaaagctttctacaaaactaacagatcgttatagcctataaaattttaattttatataacactatcatgtcattaactagtgtaagtataatatttattttataatttgttatttattttgatatcgttttttgtccttgtccgactataaaaacaattatagattattaattgtctttgtactaacataaatcagattatagttttgtttaaggccatgttcgtttttcacggattggaggctcgaaacggttcatggcctgattgtttctctaatttatgtaagttttgataagttggaatggatcttagtcctatcctagacaaacgaacagaccctaaaggatttttcattcttggaactgagaagttgtaaattatgtctacagaaattacaacaaactaatatataattttaatatataataactatgtcaaaaaaactaaaattcaggcaccaaaattttagtaagtcctttaaattttcctttttcatatctacgtggcgcgacgaaaaatacccccgagcgattattgttttgagaaaaaaaatatttctaaacgagaaatcgcagatacgacgaggcaagatcattggaaatctcgtgctgttgtgccatcttcgggtgaggtcgatggcgccaaaattgctggcaccgatggggcggctcctgcaaaacggcttgacatctccaacccaaatttttccaaggaatgcactgggcatccttgccttctggtgttcggtgctcgtggatgagcatagagaggctgagattgtgcatcgtagaagagatcaaaatataggtttacccatatgttctattctagaaaaaaccaagcttacaaaaatatgtcctcacaagtgacaacatcagccaaaatgtttggcaaattttgactgaaaaccctagaaggaaaaaggaacctacttgcggaaagaaagaaaaaaacgccctcccatggctatataaattatgtgcacctcgacacttctactcaggccacacactctatttcctacaccattcatgcggtgcggcccgcccgaagtccttggcaggcagctagcttagcacgcacgtcgtccatggcgcccacggaggaatcggctgctgatacgccagcgccaccaccgccgccacctcacttcgttatcgtccccctcgtggcgcagggccacactcccc

SEQ ID NO: 12999 - DNA, 701 bp, Zea mays
tggcgaaggcagaaggacgcgcgtgctacggggacggggagatggggaatttgttgtgcgtggggggtggggatccttgctggctcgctgctgtttgctggtgcctggtggctgcctggctgttgcggtgttgtttttgcggttttgaattctgtttccgtggttgcagggttgggctgtccgctgtcacattgaactttcatgattgcttcccgccttttctgtccgaaacccacctgttagagaagcagcccagtcctgtgtgccattgccgtgccgacgatgtcaccgcaagacggacacggcaaccattgcctttcgcaccccccgaggccacgccgtttcagcgtgacatcaggctcattcgacgcccgccgcaacacgcgacgccgcgcggccgaccctgcactgcagttcccgctactcgtgccggaccagtgacccctgatcagtgctggtccacgcggggtcgctctcggctagacgccaccgcgtcctcgttcccctcccgacttcccgagtggccgagtcccgtcccgagcgaaaagtcctccggcctcgccgtctcgtctcctcccctagtagtcaagtctcaaccacctccccaagccgcgtggagccctcatccagatcggagccagcgcgccgtgtgatgccgttccggccgtgggagtagctgtcttgcccccggcccaggagcc

SEQ ID NO: 13000 - DNA, 1417 bp, Zea mays
ctctccagtcgacctgcaggttttcgttggctaatatcgttgggtatcaaactgaaacaggtagggtgtagcatcatggtagtttgatttctgctgtggtgttagttggagggataatgattagcggctagtggattaaagttacccataccgtttcctttcgttccaaaagttcgccttcatgaggcctctgatatgaaaaatgctgggtgttaatgcttctatgctctgcttgtgttgtgcagttcatgcttctctcttttctccattgctcttgattcgtagcgtggaaggtgttctgttaattcatggaaattctgttccagacttgtgtctagttgaattctgggacccagtagagctgggccatggccattcacctcccaagaccaaaccagtcaaattcttgaagaagctgggtgtgcccttaactgcatttctgaatacaacaggtaactactctcatggcacagcgcgtcatgtcgtcgcccagatttggctggagttggaaatgtttgcaattaaggactgttccttgctgctgaggctttctactcgtgtcttcgcgggcgggcgcgtgtacacggcactgcatgaaacagttcgctgaagagagatggtcaggacaaaccaggggcctgtcaatcttccgggaccgggaaggtgcttgtcttcgtgacaagctatctcccttttcgaagtctcggtttgatccaagtcttacccactagggattcagatgatcctagctaaaacacagcgaaactttaaccaaaatatataccatctctttggccgtttcagcctagctaaaatatatacgtttagctagaatccaaatagtcccagctaaattttagctagccagattaggcaattaactgaccaaagttcagttaagatggacctaaacaggacataagtagatggggaccactacttttgacttggctattcgatcttttgattagggtatttgtgctcacatctttttcatgttttagatcgatgtgcgtaaacaaaaagaccacgccaattttaggcatggggaagattttttttaattttcttatcggcaactcacgtttccgacttaacattctcaggtgggtacagtagcttccgggcattttcctctccatttccgcaccgctctttggctttttatataagctctctggcacggctcctcgttcacgctctctgatcgcttcagctcagctgctctcgctcgcctcgcagatcgcaacccacccttagcctgcaaggaactcccctcttgcgttgcgccctcgcccgccctcctctgtaagttgtgcactgcattgttgtcgcgctggcaatctggggccgaaaagcaaaagcgggtgggtttgagctagctagggcaggctcagctcaggcggcgcgcaacgca

SEQ ID NO: 13001 - DNA, 1500 bp, Zea mays
tttatgtttcaacaagtgtgtttgacttagagataggaaattgaatttgatttgcaaaaacaaaccaagtggtggcaaagaatgatccatatatgccaaatttgaatcaaaacaattttgagttctcatttgtattgatgttgcacttcctttagttgctttttattgtgttggcataaatcaccaaaaagggggagattgaaagggaaatgtgcccttgggccatttctaagtattttggtgattgagtgccaacacaagtggacttatgttaatctatgcaaagtgatggacaaagtgcaaatcaagtaaaaaggtatgtttctaagacttagtacattgttttggagactaatgtattgtgtctaagtgctggaaacagggagaaatcaagttggaaaagagatggctttgttcagccaaagacagctcggtctgggtgcaccggacagtgtccggtggtgcaccagacagtgtccggtgcgccaggccggcgtctgtcaactggctgctctcgggaagcaattaacgacgtacggctataaatcaccggactgtccggtggtgcaccggactgtccggtgagccaacagtcggccgggccaacggtcagccgcggaatccgcgcgtgacgtgtggcagagccaacggtcagaagggggcaccggactgtccggtgtgcaccggacagtgtccggtgcgccaacggctctgaaccgccaacggtcggcttcgccaaagaaggaaagaaatccgcaccggacagtgtccggtggtgcaccggactgtccggtgcgccaagcgacagaaggcaagaattgccttcctggaatgctctcaacggctcctagctgccttggggctataaaagggacccctaggcgcatggaggagcacaccaagcaacatttgagcattgttgatcattcacacttcattcttgcacacttgttcgacattcttagtgatttgagctccgttctagtgagaaccttgtgatactcttttgagctcaagtcttggtcttgtgtgtgcgtatttgctgtggatttgagtgtgttgcttccctcccttactctagtgcttcattgtgattcttattgtaagggcgagagactccaagttgtggagattcctcgcaaacgggaaagagtaaagtaaagaagaacaccgtggtattcaagttgatcattggatcacttgagaggagttgagtgcaactctcgtccgttgggacgccacaacgtggagtaggcaagttttgtacttggccgaaccacgggataaatcctcgtgtctcttgtgcttgtccttattgtgtctattgtgcttcacaagagctctcctctctactcacttgatttcattgttctaactcttaatcaagtttgtggtgttaagttttaagttttacaggatcacctattcaccccccctctaggtgctctcaattggtatcagagccgttctcttcaagaaagggactaatcgcccgaagag

SEQ ID NO: 13002 - DNA, 221 bp, Zea mays
ctgcaggggctgactgaccccacctgccagtggacagctgctattcagaaccgacctaactacgcctacgccaacgagtggacagctggcatcgcttcgaacttcaaaactcaaaagttcgaactcccttcgcctctcgccacagcgcgcgagaaacccacccccgtcgccgtcgtcggcatccgccgccgcaggagaagcaccaccacctcgggcgcgct

SEQ ID NO: 13003 - DNA, 65 bp, Zea mays
gcagtgattactgatccagcttatttcaatgatgctcagcgtcagtccacaaatttgcaggccgc

SEQ ID NO: 13004 - DNA, 91 bp, Zea mays
actaagttgttttaccgtgtattggggagctaggatcagagaccgtcagttttccttgagcccgcagaagttcgtgtttttcgtgtatgga

SEQ ID NO: 13005 - DNA, 146 bp, Zea mays
gtgcacacagttgaccttccccaaaatgcctatgccaataatgtactactaatcggctaatcctagtaatacactatgccgtgtgcaatactccctctctgatccccagacttttgaccgccatcaaggcctttgtctgcgccgca

SEQ ID NO: 13006 - DNA, 53 bp, Zea mays
gggcgtgggcgtgggcggcctatacgaggtcgtgtacacaacgtcgttagtct

SEQ ID NO: 13007 - DNA, 488 bp, Zea mays
tacatccatttctcgctttatatgtttgtttgtagtagggatactacgagtgttccaagattaatgcattatatttgatagtgtaccaaaaaatggtagttaacatcaaggttggctgatgtactctgtttattctttgacaggaattcatttcgtacagtgctaacgactttgatacagaggcataaacaatctagcctaagagaagaacactggaaccatggtttcaaaatcatactcaaattctgctagacctgacctctggagatggatttgactttcgacaaccttttaagtctcttcctcgtgtcgtaacttctcctggtattatatctgacactgattgggatacaataagtgatggtgattcagttggttcagcatcttctactgagaggaaaataatcgttgccaacttccttccgttgaattgtacaagagatgaaactggggtgctttccttctcattggatcatgatgcgcttctc

SEQ ID NO: 13008 - DNA, 1500 bp, Zea mays
ggtttgtgggtaagcatgcaactacatacacatcacaccccctgtgttccagctcgatgataggtggtatgttggccatgcagtttgtgtaaattccgtggcctgccttttctacttgatacagtactctacgcagcgatttgcagtgcttgagtttatattcaataataagagaacctatgccctttatgtcttgaattgtggctgatgctgtttgatgtatcactgaagtggcaaagtgaggcggttttttatcaacggatgttgtaaatggagccatcacatcacccgttcaccgatcagtatcggcggctgatagtggtagagttgcgtttccgtgggactaatcaggagagtgtcgctacaggaacgcccaaatgcatcgtcaagtcgcatcgtacgagaagagccaaagtagagtcacgcagatgctcgaatctagcaggcttagaccctgttcggttgttagggattgaagctccggattaatttctagccggattacttctttaatttatatagattttgatgagctgaaataaatccatgtctattgctgtgcaaacgaacgcgcccttagcattctgcacgcacggttttaaaagtgttgagaatagcgattagtctcggctaatcgtccgcgaatctgtgatggagaggcggtggccactgccactggtcgtctggtcagcaggtcacaccggcagccacagctggcgcgaatattccagcgacatcagcgccgaacatcttcgccgcatctcccgctcgccccgggtcccaccggaggccgccgtcgttctccccgcgcttccgccggaatattccgcagccacagctggactcgcggtcgagtccgctccggacgaggatatgtcatccgactcgtgcgattcgcgttcagtttggttcccacgcaaagatttccctcctcttgtccagtctgagtgctgctgctgctgctaggttttgccgttcacgtagcatagcatctgacgaaacgccaggatcagacggtattttctggtgaaaaattcgacgcgtcccaaccccagccgtgtgcttcttgttgccaattgtgatgtgggtggagccgccgtcttggcgcctgggcctcaatgagcggcggccgagtggcgcccccgggttggacctggaggcgtgatgcccgtccgctttgttcttgcattgcatctcgcacgcaccccggcccagctgccaagtgccaacaagtcgtcctagattcctcgcacacatgacgccctccttccccgccacgctctgcgctcctcctctcgctcctcctcttgtcctcacatacacaaacccctgtgcttgctaacgacgctcgcgttacaacttattacacctacgaccaggaggcggtaacgttacattcattctctcttcagcaagagctcgtctcactcgagcctaccactagccgtgtctttggccaccggatagctaggaagcggcgatcgccaggaaggaacgacg

SEQ ID NO: 13009 - DNA, 953 bp, Zea mays
tggtgcagacatgtgggccgcgccaggtgagtggacccaaactgccatcacactgtctgcctatttgagcctgacgcgtgtcgtcgcgtcgtcatcttcgttctgagctctctctctctagtctctcccgtccctacccaccaaatctcgcagtcgcagcaggtccaggtgctcccgaggaatccattcccaatttgcgttcccactcccaccaccgcttcttcccgtatcccttgtcctccctaatttcctctcacaaaaagcgggtgcggcgtcctgccactcacctcggtctcggggggcgccgtgcggcgggcgcccgtgctgctggtttcgctccaggggagaaggggcagagggagtagagcaggttaggtccgtttgcgttttcttttgcgggtttgtaggtcaaaagctcggcgagtactttccgctccacctcctcacgctcggaatcaaatcgatgccccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcggtccgttatggggtgaaccgaagcgttcctcgcagggctgtgggtttattacgccgcctgtttgcttccccgctccatgtccttgtgcccatgcttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttratgcatagatctgcttctggctgagataaggctctaagttcgctctgttgatggggctacc

SEQ ID NO: 13010 - DNA, 1185 bp, Zea mays
caaaattcgtgatgcatatgtcgtagttcctcaatggatgtaaggtcccggtcaacgatgtcctagccttgctatactaacttggccttagtgatgcaaattcatccccgtcgggcgttatggtcgattgtcgtctcacggtggggaactccaagcgttgtggtgtggaggggagcattgagcaacactttgtttgtttgtttgagctgcatctcctagagcgtttttttgttgttgcaaaacagcaaaatggtgttgttgggctttcaaatttaagaattcaatgataaaatttcgataatactgttagcttcataaacttaggaagttacaaaagtcccataaaaatagactttccagtttttcatataaactcagcttttatgaacttttaacttttttcggaatctaaaaaaacatgtgtgtttgtgtttaattttctgttttctcacgaaacagacatggcataaaaacgtgttgactgaaggtcatgcaagcatggcctaactaaagacgtgttcgctgttggcctgcaatactagtttggttccagggtttcgtggactcaccgctagatcggaaatgaactgatgcttgaatgaatgagtttaatgaagagccgattttttaatcgaatgtagaggatattgttatctggaactgtgtttacaagaatgtcacccacttccatttgggttcatattactgtgcgttagttggatcccagatcggaggaaagtcaggtttcatcaccaaacccactattaaaattcaaacaaaatgttgatcaaagaaacggccacatgtaacacactcttgagattttaggaggtgggcacatgtaatatgaaagcaaaaaaaaaaatctcctttttttgttgttgttctttgtcgttgagtgcgtagtagtgagaaagaaagaaagcagtagaggtaggtgggcagtccaggttgcagtcccagatcgtcaaagcctcgcctcgcctacactccaccacctccatctcgtaagctccaacacaccatcaaattaatcgcgctccttctcccaccagctctccccctttttttcctgcccacatacaaatgcttgggcattagcgatcctcctcctcgttctccttccccttctccctcctctgggtctgggtgcgccctcccctgctccacttctccggcgctgac

SEQ ID NO: 13011 - DNA, 1500 bp, Zea mays
acggatatagaggatgaatatagaggacgttgctggagacagcctcagactgcttgctttgtgccttcccgccgttgactccgaagtccaacgcctgcattttctttttcactttgcacgaagctatgctgagcatgacacagaagtacagaacagaagctacatcgtcatcgtcatccccaagcaccacaaagaaaggggaatacgttgttgttctttcattctaggtacatgcaatgcaaccgctgcaggtgcaggggcaggccggtcctgcaaagcaacctagcagcttctttgcttccaactcacgtgctatctctctatctgactctatctctctctctctgtgtgtgtatccaaactgaaacaagctttctagagctcgtcggttccggtttcgttgtccgggaaatctgaacgcagctctcagctccaaccccgtgaaaaaaataaaatcgaaaggcatgcttgcttgccggtgtccaagttaggtgcaacgaaaacgaaaagcgacaacgtcggttgctgcttctctgtcgacaaccagtttggtagacctgaaaacgttaatgcatatttttttgaccttgctacggctgagctcgatcggcgctgctagccgatagttccaaatggtagcgaggcagaggcttgctggtgacaggacaggcaggcagtctcctcttcttcaagtttagcttcttcagcggaccatgcggcttcctccagatcaaggaacaattggacatgatacctttgctactataccttctcttcttcccgtagttacatcatgctccctctgtcccacaataaaaatcatttttggaggtttattggattcacacaatacttcatctatgtgttatatatatatgtctaaattcatcttcatccatttgaatatagacccaaaaaaaatcaagaactaaaacacctactatcagaaattcagcaaagttgatttcctgtaaagcacacaaactggctactttatatattgtatgcaacaggctcagaaaaaatatatatagctcaaccaagaaaagcacaaaagaagctaagtactagttacaaccactggaagattatataaggattaaaaaatcaaaagctacaacgcggagggagtagtttttatagtttcctggtcttcaagactagctatggaatatggattatgctgctgccacaggcccagcgcattccagcatcaccatggcgctcgaacagaagaagactatcgtggtggggctatcacctcaccaccgtcgcggttgggggctcaaaccaccgggtggccaaaagcccgtgtaagaagggcaaggcaaaagcttccgctcggcccatttatgaaccaaaagcccataaaccagcgcttcttgcgtcggccgctataaagggctagggttttttgcgcatctctgattccacgccgccactcacgaccacgccgcgcctccgcctggaaccctttagccgagcggagcaaggaaagaa

SEQ ID NO: 13012 - DNA, 154 bp, Zea mays
ccttggcagtagtgctttctccgcctccgcatgcacggaagcgttctggcttgaactcgccagggtcgtcagaccacactgtcttgtctcgctctcgccctagagcctccaacgagaagacgatcttggtgcccgtaggaacacgttgaccatc

SEQ ID NO: 13013 - DNA, 889 bp, Zea mays
gggtgcggctgcaccggccccctaaaaatagagggccctcgccactggacgcttgcacttttccctgttaaatctatcctagacataaatatacaaagagcgatgcgctatcgaccaatctcgtttagattattaaactaatgtctcaattacttatcaaatactccatatgtttcaaaatagtatttgttttaactcttgatttttatgtttatattcaactagatgatgatgaattcactaaagaaacaaaacaaattctatattgatatagagtattatttattatacacatgatggttgcatcggcggagggaagcttttaaaattgaaatatttttatgaactatttaagttcaacaataactcaagggaggttaaatggcttggcgattctatatatgtatcgaaaagaagttgttgaatgagattgatctcaatgatataagcgaggactttgtatcacaaaattttaaaaaatattattaatgatatcagataacaactaagtgtttttgactacatatattttacatttgttatcttataaacatcaaaacagtgcataataatttttatacgtcaaatattcaataatatttgtatagttatatatatttgtgtgtggcgtagagtctgggaccttatttttgttccattatttaaaaatatatatttgtgtatgaatggcgcctccatatcagattttgcactggacccttaaaaagtcaggaacggccctgccgccaacctactaattggtcaatacacattacacaaacatccgacatatatacacagctagctgattcctatttaattaacaccccggtcccaacttacaaagcacagagaagacctacaccgcacctgcacacaaggtagcaac

SEQ ID NO: 13014 - DNA, 1500 bp, Zea mays
tatcataaaacttcactaaaatatagttctacagtataaaacaatattttacacaataactatatacgtgacctttgcggaggagatctataaagatcgtaggacggacgtggtagagtagaatgctggagacctggacaagccgagtctgccgtagcatgtagcatccacaggctgctgcggcagtgcaagagtgtgaccctcgctcgcttcgaggccacctcgtgactaatcattctagctgggagcctgggattaacggacgacaccagcgaggggagacgaggaaaaagaaaagaaaggcgctgtgctgccgaaagagcgaggagcaaaacggaggaacacaatgatagggagtagtacggccgcgcaactctgcgtacaggtcaaaagcgcccctctgcctctcttttttttcaccgcttctccctcgcaacgatacacggaaaagtggaaaaataacccatctgctgtcagctccctccccctgctactactactatacagtaaccccctacaaacaatcattcgcagctctccccgaggcccgaggacaaggggaagcgctgcagtaaccacgccatcgctccagtccatgtccactccaacccatgaaccgaccgactaccgagcgagtggaaaggcctccctcctctttcttcacgcataatccatcatcgccagccacgttcccaacgcccggagcccaatgcggcgctgcgactgcgaaggcgcgagcgtcacgggaaaaacggaccggaccggaccgaggcggcagaaaccggacgtgtcgatcaaacccaccaccacccgcggtttcgtcgccaaaacctggagaagctgcggcttcatccgttccgcggcagtagaggcgctgggggcttgctggcagccgagccggggcccggggccggggggcggcgggcgggtggcagcccccaccgcaccgcgcaagggaggccgcgtgacccaccagccagccaggcccaggcagcaggagagattcgcacggctcgctcacgcacacacgcaaaacaacgccggcataaatgcggttttggagccgtgcgggcgtgcgtgaactgtcctctcctcccgcagcggctgcggacaggagacgacgacgcgcacagaaaaacaaccgcttcccgcaccgcagtcccccgcccccgccgtgccgtgctcccccctctgccagcctatgcagcgcccgagcgctcgcctttttgaccgcgtccgcctgccgccctgtcctgtacccctccctccctcccccctcctccccttcacagtgtcacacgcacttctcgttctcgccgatccagtgccactacactacaatactactgcgcggtagcgctcgcactcgcaccacaccacgccaccgctgctgcctgctcctcacagtcctccccgcgctcgcattgcgattcgcgacctagcgcgagggtacggggggtggtgcgcgcgcgtgctcggtgatccgggaagcgccgcgag

SEQ ID NO: 13015 - DNA, 380 bp, Zea mays
ggtgacatgtttcaggctcagtgcacacctgtcccgtgcagtcgggcacccagcctggacgacggtctctatcacgcagacgtcagctaaacgctgcccagcccagccccagccccagctgctgcaggcagagacaaaagtcgggaacccacagcaaaccaaaccgtgtgctcctcttcgtttcggccgactcagccacgaaaagaaaaccccgggcgccacgcggaaaaccacgggacgacccgacgcctacctcccccgcgctccgctttattagcaaaagatcccagcagcagagcacaagctgccttgcgcttcggtgatcacgaggacaccaccaagacgacgcaggttcactggttcagcgaccggtttccgcg

SEQ ID NO: 13016 - DNA, 361 bp, Zea mays
aatatatattttttaaaataaatcaattcctactctaaaattcctgaatttggaaggagggcgcaaatttctccttttttttcgyagtgcttctctttcttgccgtgcccccactccgctcgattctcgactctagtcaccccgccggaccgccgtctcacgttctacacccacccactcctgactccgacgacgccgttcaaacccacgcaatccagcagaggagaccatctccgccgccgacgacgccgttcaaaccctagccgatccgctggctctgccatcgcaagccaatgccccacaccgaaccctagcaacacyatagtccttccacaaccggtgcgaacagtactgcccgaat

SEQ ID NO: 13017 - DNA, 798 bp, Zea mays
tctgtagtccaagcgaaggtcagatctgatcacatcgagacactatcaccgcataaatactaagaaagtagggtatacacaaccacaagtaccaatagtactcaatggtctcagatctagttatacaaaacaaacaaccaattcgactatgagctccatgttagggagagagtgcaagtgagaatgtcaaaccttctcaccttcggcgaagcctataaggagccagaccataacaacgaggagagtggagggtgcgagagcctgagtgtgattggagacgagagaaggagaatagtttgagggcgagtggagacaggagagaaagtgctcgaggcacttgatgcgaatgaggtgtgaggcagtagctctagggggcggggttggatgtaggcgagaatgacaaggcttgctcgggttaatgaggtgcttaaggggtgaatttttttgtaaaagtcgagactgttcaaggaaacagacataatttttgtaccatatgggcgttgcacgcttgaacgcgaggaaccaatcagacggactgtgaacgatgcaatgcttactgttcgcgtggttaattgctacggcccagttttgtattcatgcctaataacaactaaaaaaggccacgagcccaacttgcacccgcaccaccaggctcacagccttacctgatccttgacaattctgctccctcgccgccgccgccgccgccgccgcccgcccgtcgtcgctgcgcttcggtacccgcgaagcaaggccccgcctcccgtgtacccgccgccgaagaagggagaggagcag

SEQ ID NO: 13018 - DNA, 1500 bp, Zea mays
ctattgatgtagactatgaggcaaagtagcgacattatatacctacgacgcgacaggctaacgagtgacaaagagacaagacaggattggcaacgaacaagttaagtcacctactaaccgatcagtcactgactgaaggagcgagcgagccacgagtgagttggactttaggggagagaatcgaacgactcgaaaggttagtgggatgagtattagttgagcgttgagaaaaaagtcaaatcgaagctaaattttcattagatctggccacacgtaatatataaagttttttattttgatgtatatttaaacctggtacaagaggttatacaatttgaggtgtggcatagcccactttgcccacctcttgcgtccgcctctgggtcaaatccaagtcatgtgaccacatccgcgcgtgccacacacgcttgcttgtgttatacaaagaaaacgatattataaatatgtatatattgctaaaatataattatgtttatataaatatataaatatcttatttaaataatatctaactatatgatatatgaaaaatgtaaccatataccaacaactaactagtaaaaaataggtagaaccaacactctgtatatcagatacgaagacaggtaagagacagagggatatgtcttaaaaaaccgtaacattgttatctgggatatgtcttaaaaagacagtaacattgttatctatgctgtaatatcaaattttgatcattgctcacacgtttatgttccatatgaattagccttcattttttcgaagctcacgtgtctgtctaacctggttccgatacaaaggccgtccatttgatgtctgtagggactagtatgtgttcacgtccaataatttgatcatgatgtaatactgctaaatacttccactacttatatttatcttatcgtgttttagttaaaaaaataactaacgtgagacaaatattcggagctactgttaaataactgtcacgtaactatgccgaacgttgccacgttggccggaaaacgagtcgatgaaacgtgggctaatgccgccccgccacacgcccgcgccaatacggctagtatactgtatacctatagtattcctggtacaaattactgtcccatcaaggcatcaatcgcctccacgattacgtggcgtcgtggccttacctaattctgacgtaaaacaaatcaccactgaaacgcgccgctttaaataatccggaaacgccttcctccccctttctctctccagtttttgaacacacacaccgtttgtgagcaagacaagacaaatcgctagtggaggagcaacgcgctcaccgcctagcagcaagacacctccgctaggtttttccgccgctgaccggggcattgcggaggcagcaagccacgctacagcgcggcggaacgggagctcggcggcggcggagcgccagtccgggtggcggcggctgatttggatggtgggttgcccagctggggttcagatctgaag

SEQ ID NO: 13019 - DNA, 1500 bp, Zea mays
tgagccaaaaatgtcctataaattgcagagtagaaacatattctatcgatacataaaattgtgtgcctttgtaaataaaggaatgattattataagaagaccgaaaacccggttcatctctgtgtggccggtatgcttttaaaaaagaactgctacaaagaattgagtgagaggaaacaatcaggcctgatttgataaacaacacccacacgtattggtgaaatgcggcagaggagagatcaggacaccgggtgcaaccatgcagggagcaaagacagaaggcagggcggggcgctgtaggtcgccgccccagatcgaggaggaggagccgatggaggtgcttgtggtggctacggcggcgagttgaggaagtggatgcagttggtgctgcgccggagagccccattctcctacgtcgacggcgtagctgcgccgtctacagccgcaagatcttcggcttcgaccccggtcgtgcccgcacggcgaccacggtgcggtaccggtatagggttctcggcggcggggacgggtggtgatggggagatttttcatgtccgttcggattcgtctgggaccctcgcgcaacggccgttgtgcgaggccttttctggccgtccagatgagatcgaacggttgggaaaaaagcagagtttggtttctttgcgccgctggcggtcgcggcccaagcctgaggaggtcacagccccacaggcgcccattcggacttccctttattccccttcctatataatcccatcgactgccatcttcagatcttcttccgcttccaacttccgttccgcaaattgaaagctcggcgttgccctgcgcccctgcctcgagctcgaaggactttgtccctatacgtcgttgtccagctcctcgcatattgtggcctggtgcagattggagatccgcccggacttggatcgagtcctcctgtctttggtaaggaaaccctagtccgcttcaaagcatgcctttaagctttttttattttttgctgggatggatcatggatgcagcaaatggaccattgaattggcacatcctacgatctgagcctcgaccttgaggctgtgatgttgtttgcgaattagggcttactgctgaagtgctgaggatgcgtacgccatggcgtgcatcgacccctagtgcggactacggtgtcactgttgttggatgtttccttgtcttatatagcatccagcaatcagtaccgtttcctcatgtaaagcccctcagtttaatacttgagagctaattgggtagcatactgccgtcactgcaacgttgttttgactttaatcagcacaggaacaaggaacttctaggctccgtttatgatgtgaatccatactctgctgcttttattaatgcattgcaattacatcagatgtattgaagattatgtttacataaatattatgttggccctttttcttacttcattaaatgttcccaggacattcattggagtgctccattcattgagacagc

SEQ ID NO: 13020 - DNA, 187 bp, Zea mays
actgaccggacatgaattcttgtgcactgggatgatggacgttgctgacgttgtgtgagtgtcctcgaacatgatgtatgtagtggagtagcgcatccggtggtgcaacggctaggggtactacctcgctgatgagcccagggtgcacttcgtttggaagcccaaccaagagtcatcggtactcgtc

SEQ ID NO: 13021 - DNA, 482 bp, Zea mays
ggtacccctgctgccgcgcccacgcccacacgcaatcagaactgacagccatctccagctccacctcccgaacggctataattaggcggttgccggaatcccctctgtctcgcaccgcagcaattccccggccccttcgcaccgtttccctctgcgctcccaccccccgcccccccgaaatcaccgccgcgccccgcgtctcgcccacgctcacaaggaaaggaggagaggagaccggggcccagacgccaacgcgcggacccctcgagtagggcgaggtccgggctccgctcccggtttccggggagagtgcggaggacccccatcgtgcgcgccattgagctctgctcccggctgctcgccggggagagggcggaggacccgatcgtgccgtctcaacccgctccgcacccgcgcggccgcgggcgtggtgctcccgcgccttccgggcgcctcctgcttctccgtgcgccctcggctcc

SEQ ID NO: 13022 - DNA, 259 bp, Zea mays
aggaggtgctggatctattgatgcctaagtttggtggtgtctactactatgtctactttatgttgtcctaatggttgtaagtattttgggagtcactttgcttgcgaatgtctcgcgtaagacttatgttggtcaatggtcggttattaacttattaccatgaaagcacttcgtctgctgccctaagaggtttagtcccatttgcattataaccaattcaatccttgtggatgatttgtgtgattccatcgtgaatctc

SEQ ID NO: 13023 - DNA, 94 bp, Zea mays
ggtttaataaacatactgcataactgtatactgaagcttaaattgatatcgataatataaaaaagcgtatcttgcactgttaaatgtcaatatt

SEQ ID NO: 13024 - DNA, 204 bp, Zea mays
ggtaattttctacttacaactcattttttctgctttctgagtgggttcttttcttgtttcctttgagcttgacttttctttttctttttttaaaaaggaatttcttaagaatgtagtgcattcattgacattcctcattctgtttgtgctgtgaatagtattgcagaatatactttagaaaattcagtcatcaaacctacttat

SEQ ID NO: 13025 - DNA, 807 bp, Zea mays
ggtagccctcccccaaccatctacggtggtttcatcatcgacatcccccaaccaaactcctcgaggttcttccgaaccctagcgagccgcattacctgggatcatcgtcgaccgtgaacaaaggtagcaaaccctaaaaaggtaaatcgatcacctgatgtacacatgtgctgttttttttgttcatactgcattctaaggattatggccggttacaactatttatgctgttgcattaagacatttacgcacatttacatagatggttatgcaaattagaatacacatttatgcatctcagttatagtttttttacatagatgatgtccgagtgataaaggaggagtcaattagttgtttttggtagagtatatgacttattcaaaatttcatatatgtttagtgatatgcatacatttatttattccattagtttatagttaatacattactgtttacagccaagttttgttttattcaaaacatattcagatttttatgattataaaacaggacagaatgtgtgcatggtagtggtatcaatagaacatgtcataatgtgtgcatgatgcattggttttatgcaagtgtacctggatgaaatgttaaatgacgtttattaccactatgataagtattatgcaaaaattccatatttctttatgcatgttattgaaaacatttaggtaaatttaagaatgcatgaactgaattgattcaatcataccacacaatcaatacattcgcttatccaacagatttatgtttatagttttgtgtattatgcatgcagatttgactaaaaat

SEQ ID NO: 13026 - DNA, 904 bp, Zea mays
gcccagccacgtcacagttcgttgggattccgaccgttggagcttctgacttgtgggcccgcctgcatgtccggtgcacaccggacatgtactgtttactgtccggtgtgccagtatgggcacgcctgacttctgcgcgcgctgcgcgcgcatttaatgcgccgcaggtagccgttggcgcggagatagccgttgctccggagttgcaccggacagtccggtgcacaccggacatgtccggtgaattatagcggactagccgttggagtttcccgaagctggcgagttcctgaggccgctcctccttggcgcaccggacactgtccggtgtacaccggacagtccggtgaattatagcgcgagtgcctctggaaattcccgaaggtggcgagtttgagttggagtcctctggtgcaccggacactgtccggtggcacaccggacagtccggtgtgccagaccacaggtgccttcggatggccctttgctcttttgttgaacccaactctttgtctttttattggctaagtgtgaacctttagcacctgtataacttatacactacagcaaactagttagtccaattgtttgtgttgggcaattcaaccactcaaattatttaggaactaggtgtaagcctaattccctttcaatctccccctttttggtgattgatgccaacacaaaccaaagcaaatatagaagtgcataattgaactagtttgcataatgtaagtgcaaaggttgcttggaattgagccaatataaatacttacaagatatgcatggatcgtttctttcttatttaacattttggaccacgcttgcaccacatgttttgtttttgcaaactcttttctaaatccttttcaaaagttttttttttgcaaatagtcaaaggaaa

SEQ ID NO: 13027 - DNA, 1118 bp, Zea mays
gaccacacctaagtttcttgatatcaggttcgatacaccttctgaaattatggctatcactgaaaagtcgtatttgtattttcagtgtgaaagcataaaaccatggatgtgatgggtgcttttattttcttttttttaagatgctcccatgcatggagtaataaaaagtaactgatcaatttataaacatattgtaataataaaaacatgtattagattaaaggaacatgtaatattagagactttatcattgtctaatatgttgtgaccccgtttggatctacagtacatgcatggggtttacctgagagctagaattaaactagctcatgcatatggttgattgtgtagtaaacttacggcgcccagataaagaagatcttgggtgatttttaggcttttagcagctaactgttagcaatacagtgtaaaaaaaggccctaattaaatacctatggcccgcccgaaggagtatacgcgaccaaatgaaatgtagaaaagcacctattcaagagatcaattattgactaagtttacacaaattgattggcctacgtacgtcggtggaagataatgacgcatacctatgcatccaaaaacaagtatgaactgtatcacaaatattttctctgcatatatacatacagctagcagcaatgaattctacaccattttttctgacctggaagacctgaattggtcgatgctccatcctaattgcattgacgtgtcaaataaagctagctagctttctacttgtaggattaggactggaagatgtcaagatgcaccgctagcgcgctgcaggtgccaaaatggcgcacgtctgccagcagaagctgaagctgaccctagctagctagcggtcatggaaatccttcgtcgtcgcctccgcgcgcgccgtgtctctcttgtcacgttcggcagcgaccagcgaccgcgccgccctgtccctgtgcaacgactcgatcgtctctcttggcaagtccttataaagttataaccccggcccgacgcgagagtgacacagatgccggctacaacgacgacgtactagctagctagctcgttcgatcgcgtgcgtcgttccacaccgacgaccggcggagacgagcggc

SEQ ID NO: 13028 - DNA, 105 bp, Zea mays
aatcatatcatccgcgttgttgacttgagtcccaatgggtgttgtgttgcgtgaaacggcgtcagccgcctgacgtgtcttcagacgggttgaagtgcttattga

SEQ ID NO: 13029 - DNA, 267 bp, Zea mays
ggtaataaatttaaattttgttccagaagaaagacttttatatttgcttcagcttaatggttgtttgatttttgtggttcttagtttaataattttggtacaaataagcaaaagtatgataatgctgttaaatcttatcttctactccatgcccttatgattatttttcagctctcttatgatgattcaatttcactatcaatgcttgtttgaaaaacatttacatttctctctttcaagttttgctgcttttgtgtggatgtagtc

SEQ ID NO: 13030 - DNA, 416 bp, Zea mays
ttgtctctgtgggctggttctaaacgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgttccccacgaacgcgcccaggaacattctagaacaccacagcccacgcgctgacgacgagccctttgttccctataaaagccactgcccggctcagtctctcgccctctcgaaaccctagtcccctgctccattctcagccgccgccaatcccttcccgtgctccgcaaccgctgagtgagaagaagag

SEQ ID NO: 13031 - DNA, 1500 bp, Zea mays
atatcttgtaagtagttatattggctcaattccaagcaacctttacacttacattatgcaaactagttcaattatgcacatctctgtttgctttggtttgtgttggcatcaatcaccaaaaagggggagattgaaagggaattaggcttacacctagttcctaaataattttggtggttgaattgcccaacacaaataattggactaactagtttgcccaagtgtgtagattatacaggtgtaaaaggttcaccctcagccaataaaaagaccaagttttggattcaataaaggagcaaaggggcaaccgaaggcacccctggtctggcgcaccggactgtccggtgtgccaccggacagtgaacagtacctgtccggtgcaccaggggactcagactcaaactcgccaccttcgggaatttccagggcgactcggctataattcaccggactgtccggtgtacaccggacagtgtccggtgcgccaagggaggtcggcctcaggaactcgccagcttcgggaaacgccaacggctagcccgctaaaattcaccggactgtccggtgtgcaccggactgtccggtgcgcctccgaagcaacggtcatctccgcgccaacggctctctgccgcgcatttaatgcgcgctctgcgcgcgcagaagtcagaatcgcccatgctggcacaccggacatcaaacagtacctgtccggtgtgcaccggacacccaggcgggcccacaagtcagaagctccaacggtcagaatccaacggcagtgatgacgtggcagggggcaccggactgtccggtgtgcaccggactgtccggtgcgccatcgaacagacagcctcccaacggccacttttggtggttggggctataaataccccaaccaccccaccattcattgcatccaagttttccacttctcaaccactacaagagctctagcattcaattctagacacaccaaaagagatcaaatcctctccaattccacaaaaggctttagtgattagagagagagatttgccgtgttcttttgagctcttgcgcttggattgcttcttttctttctcacttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgcaagaaccgaacctcggtaaaacaaatccgcgtgtcacactcttcatttgcttgcgatttgttttgcgccctctctcgcggactcgtttctttattactaacgctaacccggcttgtagttgtgtttatatttgtaaatttcagtttcgccctattcaccccccctctaggcgactatcaattggtatcaaagcccggtgcttcattagagcctaaccgctcgaagtg

SEQ ID NO: 13032 - DNA, 690 bp, Zea mays
gatggtggactcaaaaacgatgcaccaccatgtagtacaaaatagtgttttaaacgtcgttgttgctgctcccggtgcggcctatctttcagattataaagggttgcaggaattatggtttgcatctgggttgtatgggatttttttctgattagtgacaaggaaattagatatgattgagagggagaaaatgccttgttaatgtcattaaaccggaatagccgagaatttcctcccatcaaatactctcacattcctttgtcaaaccagcactagagagataactagcaggtagacgaagggagttggaaatcaaaagtaaacccacccgatcgccgccataattaccgtacggttcctcctcctcggcacctcccgtgtgcaagtggcagggccagacacggcgggggccccggcattactcccccgccataaattctccgccgccgcacaaggcagaacggaagaggtgtccccgctccgcgcccagcggtaaccccacccaacccctgtgagctgtgacacagctgtactcctctccccactccaggcgctcacactcacatccccttccctccacaggaatccgccgccacaatcccctccgctccacattgtgggattgagccgaacacaagcaccctcctccccgaaacctcttctttgccctgctttcggtggtatggtgcg

SEQ ID NO: 13033 - DNA, 1500 bp, Zea mays
cgagtctcacacggtcacaccacatggctggcgagcggcgccggcggcacgtcaccatgtgcgagaatttattcgcttgtccatttctcccacatacccctcccctctccaccgcccatctcttcctcctccagtcccgaaggaaggaaggtctggctggccctggcctaccaccaagaacacacgctgcggcctgcggcctgcggctgcggtcacgctactcaagtgtgaacaaaaaggtccatgcttctcctccctttcgctcgcttccttttctctgcccatccacgtgaaaagcagcagcagtggtccctaagtagatcttggattcgtctcatcaatcacactccaccaggagtaacccgcacacgtagcgtagcagcaggagtaggtaggtgggcagcaggctccttgtggtgtgccctgcatgtttcgcagcttgcttcttcgagcattgaccccttccgccccgtccgtcatcttccccacctctctctccgcaccgcaggagcttggcggcggccgtgaccggcgctggagagtggagatcttggacgcgtgcgacatcctggtctccgctctgtgcctctggtcttcgaaggcgccgccaccctatttttttttttaaaaaaaatcctaaggtgagatcgagctgctctttgctttgctttgctttgctttgctgcttgcgcggaatctggcctgcttgctttcacagttccacttcgttgcgtgtttcggtttattgattgatagatttcaatcgaagcttgcagattaggtttcttttctagctagatcctgcagcatctacgaggccaggccacggtcgactggttctccttcgatctagtcttccttcctttccttcctttctttctgaatgcgcatggtagtaccaccataacacagctatccttttggtgagacatccagttttctctgtctttgccaaagacaaaaaaaccccccgctattggtaatacaggcagaggtcgtcttgagaagacggatagctatgactgattatatattttttttgctgcacatgtttattaccgagtccattgctctgacgaactgatctcctgtaccattgttacatgtacctttgtttgaattggaaatcattcataccatattactatcaatccaactaacaggactaactaccttcccaaggatcgtacactaacttcttcatccgaagtaccttgaactagcatgcttgctggcatcactgtctgttacacgctgatgccgcactatttctagccttgattacccaacgccgagttcacctcaaatgcttccgttataggaaaacatgattctatatgccatactcatttttcgctgtattttaaccattttaactctcatatttgtgactgctatagtcactgtctctctctggtgctgctgcgcatttctgaatttttcagatagtttcttcagtccgacaccgcttctagcttcccctcggcgatctgtgaagct

SEQ ID NO: 13034 - DNA, 1500 bp, Zea mays
cattactctatgaattactttcttttgtggaagaaggattggataatttttttttagttttttacactcagcaaatgtatatatatttgtgtcttgggatgtgatgaggctctccaaaggattttgacttgagagtaggtggttcttggtacaataaagttaaactcaaaaactctgatctactatagacttctgcacaatagatttgatttctttcaatgccaagttgtttggcagagttctggctcctggaaatttgtggatttcgtggagctaaggggatgtttaagatggctctaggttctagctccagtgtggagctgtagtttataatatcaatttaaataattttaaatatattttcaatctaaataataaacaaaataactttctaaatgttttctaaagacttacaggtctagttccacgattttcgggagcatctaatgacctgtttcaccaactttaccaaattttytagagctgtagctgtcccaaacagggactaagtattcctaactctgaaaatctttgrgtctagatggtatactttagttgttttgttaagttgttttctttctaatctagacaaaacatataatctcaagattcctaattttagcatacaaactccataccagagatagaatttagaacttgaactacacaaataaggccttaagggacaaagaacctccatctgtataaagtaagggggtgtttagtttttaggaactaatttttagtttcttcattttatttcattttagtccctaaattactaaatataaaaactaaaatagagttttggtttccgtatttggtaatttaggaactaaaatggaataaactgcatattagtctcatgttttctgtttcctattcattgactgctcatgctcactattctatttaatacacagctaatcaagccctgcccaagatattatggtggtggcatagacgacgaggctacaagctgccctgattttttataaccggcctttcttggctctggaatctttatgatggttgatatacacacatttttacagattccgcgttgtccctataattctataaatcgtccggtgcctcatgtttctagtacgctgatctttacgatgttcctcaagccgagacgagagaatttgtgcccaaaccatacccagtgaggaatcagtcaccaagagcgagcccgcagtactgggtcggcaggccacgagcgagcggtcagcatccgcaggtacagccacacacccacgcacgagcactcccagccggcccgccgagaatccactcacccgctggttcatgggctccacggaaacgatagcccacacgtcagtcccttccacaagacccaaaccgtctccggagtaaacccccgagatctatccccgtttccaacctcacacccccccttccattggagctccttcgtctgagttaaacctaaaccctaatcgcgacctgcgttcgtcaaaaccctacctggcc

SEQ ID NO: 13035 - DNA, 1500 bp, Zea mays
acaatccatgcatatcttgtaagtatttatattggctcaattccaagcaacctttgcacttacattatgcaaactagttcaattatgcacttccatatttgctttggtttgtgttggcatcaatcaccaaaaagggggagattgaaagggaattaggcttacacctagttcctaaataattttggtggttgaattgcccaacacaaataattggactaactagtttgctctagtttataagttatacaggtgctaaaggttcacacatagccaataaaaagaccaagagttgggttcaacaaaagaacaaagggccaaccgaaggcacctctggtctggcgcaccggactgtccggtgtgccaccggacattgtccggtgcaccaccggacatgtccggtgcaccagaggactccaactcgaactcgccaccttcgggaatttccagaggcactcgcgctataattcaccggactgtccggtgtacaccggacagtgtccggtgagccaaggaggagcggcctcaggaactcgccagcttcgggaatctccaacggctagtccactataattcaccgggactgtccggtgcaactccggagcaacggctaactcgcgccaacggctacctgcaagagcatttaatgcgcgcgcagcgcgcgcagaagtcaggcgtgcccatactggcacaccggacaaggaacagtgcatgtccggtgtgcaccggacatccaggcgggcccacaagtcagaactccaacggtcagaatccaacggcagtgatgacgtggcgggggcaccggacatgtccggtgtgcaccggactgtccggtgcgccatcgaacagacagcctcccaacggccacttttggtggttggggctataaataccccaaccaccccaccattcattgcatccaagttttccacttcccaactactacaagagctctagcattcaattctagacacaccaaagagatcaaatcctctccaaattccacacaacgccctagtgactagagagagagatttgcttgtgttctttcgagctcttgcgcttggattgcttccttctttcttgattctttcttgtgatcaaacactcacttgtaattgaggcaagaggcaccaattgtgtggtggcccttgcgggaagtttgattcccaagtgatttgagaagagaagctcactcggtccgagggaccgattgagagagggaagggttgaaagagacccggcctttgtggcctcctcaacggggagtaggtttgcaagaaccgaacctcggtaaaacaaatccgcgtgtcacactcttcatttgcttgcgatttgttttgctccctctctcgcggactcgtttatatttctaacgctaacccggcttgtagttgtgattatttttgagaatttcagtttcgccctattcaccccccctctaggcgactttcaattggtatcagagcccggtgcttcattagagcctaaccgctcgaagtg

SEQ ID NO: 13036 - DNA, 280 bp, Zea mays
agggaataaaaataagcaatttttttccctgcggggccagtcggggccccggacacctttaccctttgaaaaaagtttgatttgaggaggtcccgactcccgattatataagcagcttccggcggtagcctccgctgccttcccaatcatgagaaccgcgctcccgagtcctctcgctaaaccctctctgtgaatttcgtgggtgggtcgttggctaccacgaccgcgtcccatccaaagagaaagaggcgctgcggaggaggatagtagcagctagcca

SEQ ID NO: 13037 - DNA, 1333 bp, Zea mays
gaattcgcaacgacacgactacacgaggccaggccaatggagcgtccaagctactgtaggagtcccagctttcgcggcgcgtcgttttcgttaggccgtagggggacggatttcgggatttgaaaacctgggcatattctgcgtccagaggattcgctggggatttggggggaggttagaatatgcggccgggtgcttgctagtactgaacaaaaaacaaagggcaccgaaagccgcggtcgcctttctcgcaccggcgccgggttgagatgagaacgactcgggtcgctgttctgcggaaatgggggcgcaggatatcgtgtggttgctggaaaaaaaacatgtgctgggctcgacgatatttttacccctcgacgacctcgaaggatgctgctatagctcctcttggccatagaacaggagcaggagtgcatgcagagctcctgcgccggccggcgagcatgaggaactgaggatggatggtaggcatatgtgaggaacatgtgttcggttcggtgacggtgacgccagccccggcccttgcctgtctgcctacgcaggagcctacctgcttcatccggctctggttcgtccatctgttcaacctggcttcatgggcgcgtgacctgagcttaaccaccgcctcgtttccgcggtagggtttactagctggtgtccgttgctcggctagcaccgtagcacgcacgtatctccagcacacggtgacaaaaaggaaagctgcagcgagcattttcaggcaacagtggtaactattagtagtattattctgtgatgcgatcttcatacatagtggctgcatggatggttaaccgtggttgcctcttgaccacactaccggcgtggcgtgacctaacctaacccgagctccctccctttcgcccccctgtctccctcgctcacgccagtacgccacgccctttattaaggcacagaggacagcacacagtattgtgggaactgcatgctgagagcaaacccagaaaggaaaaaggaaaaaaagaaaacagagagaggggagagtgggagacggtcggagacagaggcctcactcctccacactctcagtcgtcttccagtcccagcgctttcttggatcgcgaggaaaccactcggggtcggggagtttgcagttgcagagaactgtatcggccgaagtggttgcacggtgtgttggccttggccatgcgccacggcagggaacagagacgagcagcagggaggcagcaatggaggcgctcattgaccctgctctcgctgtaaagatagtccctcccgcggtgccctccgaattccacttgatccaactctcgac

SEQ ID NO: 13038 - DNA, 739 bp, Zea mays
tgcagttatctctttcaatagtagttatttgtttgcatatgatatatttwaawtctgcaggaagagaagaatacaaatgaggtccatatattgatttcattatgtgttgtgtagtaaactcagcatcgcytcacattttgaaaattatgatcaaccattgcttgcttgagcatccataatataataattcttctatatgtttccttctgcaagtaaaaaggatttatgagaaatgcaaaatcatgttttggatagagcagttattatatgattggttttcttggccaggcaggaattggcacacagattgcagaagttaaattgctggcctttgaaaggcctccttgataaagacctgcatcacctggtacatctgttaatttctgaaaagaaatggattgaagaaacttcttccagaattttccctttccgtcttaccctccctcgcaagagaagatgtgtcccatcaagttccagcaaatccaacggcctyagttacattttttcaagtgggaagccacaaaagggcagatacgttgacaataacagtaggaaaagcaggtccctcactagagaggagatactatcagattgtcacaagctggtgaaggagcttctttctgagcatgaatatggattcaacatcggaattttcaaacgccgtttttcccaggagtatggatacgagctcgaacaccggaagctcgggtatctggaccttgaaacgctgctgcatatt

SEQ ID NO: 13039 - DNA, 701 bp, Zea mays
  unsure (1)..(701): unsure at all n locations
agatggggctcgaaattttatgttagcctttgctcacctctaatgcattccgccgtgcataaattttaggtgtcaggctctcagcctctcactaggtcattttctatagataagctgatcaggtagtacaagatatgggttgcaaagatactgcaagactattgtatacctgtgcacatctatatgatcatgctttctcatggtcattgagctagactgagagcaggagcgtaggtatggagaattgcaggctggagagagagagagagacatacatatgaganagagagatagagagagagagagagagagagctgaggcgcctttgtatctgctttgtcagcacatgcattctacctctgccgactctctctttcggtcttttccactacaaaatccactttggacccgggaaaaaaaaactaaaacgcagctagccagcagcagactgcagacctctctaacaagaaaagcacaaatccatacacccaaataatcatccatccttcatcaccggccctgctcaaaagatgaacaacatataaagcagcaccacggcaccacctgcagctacatctatgcacacatctcggtgatctcttcagcctcgcgactgccaccaaatcggtcttggcaggttgctgcaccaaatcgggcggtcttggcaggttgcgctagctacccataggttggctggagag

SEQ ID NO: 13040 - DNA, 172 bp, Zea mays
ggtcagtggatgaggttccttacaagcattgaagcaagttgcttctttttgcactgagatgcttctcttcccttgcagctagaagcaagcatcaggagtggtgatatcgagagtttcaagttcatccaaagagcttggaacctcgtctttcctagagctgctaaagagaagg

SEQ ID NO: 13041 - DNA, 1500 bp, Zea mays
ttctcttttcagcgtgctcaccagctcctgattgccgagagagagagagatagagacgtcccatatattgctgaaagcaagaagtaaagcatcatgcattaacagctagcagaaaggaaagaaaaggtatcattccacttccactcctctaatttgcttatcacgcgtttcatgtcgacgtagacggaggtgtgacggggattcacattcatcagggcgcgttaccgttccgtcgggcgtcggctagcaggaggctgcatcgaaacgaaaattgttggggcggggcgcaggcgagacgacacaccgcgacaggcaggccaccgactgttaaccataagcggcgaagccgagaggcgctgcacgcgcaccgggcctggccgccctaaggattcgaaaactgagcaagccgtacgtgcatcggacggctcattgcatcgcatcgacgacggtgccatgcatagataataatagccagtacagtactcgcttagtactagtttatagtgtagtattacgttaccaaatcaaaagctaaaaaaaaacttataagtaagaacagatagatcacgttagctcatgcgatccagatttcaggccgaagcaaagcatccttggtggcgttggtttgcgtgacagttagcagcagcaagcacgaactgaaggagatcttgcctgatttactgcttgtttttattatccgtacgttcgcataacaggtggagacatgacgatggaggcggtggttctccttttcccgtcgtcgtcggtacatagcatggccgctgcctagctattctgccattctggcatagcttttggaacggggtgtggggtggtgtgacgaaagaccaagcaacgagcacctaccgctaccgtgctgtgccgtgtgcgtagcgagcagccacaaggcgaggcgcacgagaccaagcggcgccgtgacgcgagccggatagagtacagacgacgctgagtcgcccgagaccgccgtgcccggcaagcggcacacgacacgcatacaaatgcgaacacgcacgtagcccgatcgcgaggcgtcacgtgcaacagccgtccacccaacccaaggtccgtcacacgactggcaggcggacggtgggcccgccgcgcgtccgcccacgtgtcccctggtaggggggacccaggtttcagccggtggcacctgcctctcctcgccgaccgtttgctcttcgcagtgggcggcacgcggcagtggcagtggcagtgggaacgcgcgcagccccgagaagcgcaacgtcgcccgcactcctcacctgccgtgcagcccattaattactccccctcccttgcatcacccagctgcttcagacgagcgagcgagcgagcgagccaccgcccgagagagagagagagagagagagagagagagggagagtgagagtggggattcaagtttcaaactcactatcgaggggggataggaaggtggtcactcatcggtccacagctagctcgtcgcccccc

SEQ ID NO: 13042 - DNA, 234 bp, Zea mays
gttcctaattgttgcacccattttatgtttttcattacagctatgtaggtttttgtacaataatccctccgtttcaaaatagtagttgttttagctctagatttttatgtttatattcatatgtatggtaacgaatcttgacacatatataggacacatacactaaaaaggtaaaacagattttaatttgggacggagggagtactttatagtggttctggccttcttgacacc

SEQ ID NO: 13043 - DNA, 201 bp, Zea mays
ggtaatggggtccctccttttcttattaatgctaaactgctcgagtatcttagaagttacattctggatagaggcttctgaccactataaattgcaggtcctgcacttgtgacaacaaaagatgctggggatgcagtaacccttttgtagtctttagctggttccacttttgacagtagccagcttgttttaacagcttgc

SEQ ID NO: 13044 - DNA, 49 bp, Zea mays
tattgtgccaaggatttaactggggaatctcataaatcagggaaatggt

SEQ ID NO: 13045 - DNA, 682 bp, Zea mays
cgtgtgctggctgaaattgcttgaagaacagcaccaccgacctctgttcacgttcagtcaatcggcttcagaccgcgggttttgtactgcacacgtttaacgtagtatcacgcgagcaaattatagattaaccggactaaagtttaagccaaaatgcaaacaccccttggcccagtggccagagggcagcgtcatatccaatcaaccagcgcatggcatgggcatgccggcatggtgccatggtcgtacggtccgagttmgacacgcaaaaccggaaccgctgaactgagagtgagagggcgagaggcctccgctcccctgcttccccggctggctcccccacgccacccgtctactccgttgtctcgtcgcaggcagcaggtgaaaatctccgccattaagcgcgccccagggatcctcctcggccgcaaacaaaaccctcctcgtcatccgcgcccgctttcccccctgccggcccccggtctcgctctcgcccaagcaccaaatcttcctcccactcatcacaagacgaagtttcagtgcctgcgcgtgccgcgcgatctctcgtccttggcgtcgtcaagacgcgttagtttcagtgcgcgcacgagtgtgtgttgtgggagttagtgagagcgagagcgagagcgagcgcaccaagcgattcggcgggcggcggccg

SEQ ID NO: 13046 - DNA, 69 bp, Zea mays
gtttaggatctcttatatttattatatagtaataaagacttatgttttattgtgtagtagtaaagcctt

SEQ ID NO: 13047 - DNA, 809 bp, Zea mays
atagtcaaataaattatataacacagttgaagcataaatacttccaaaagacgtgatatcaagactgatagtctgatactatgatatctaatcacatactgacttttccattacgtagagcattgaattcatctacaaagcacttgagcatttctaacattttccaaatccaatcacaactgatttgatttgctaccagatcagtcaactgatgttcaacatggtcagtgggaatggcaaattgtagtcttgtagggtttgtcctgacctaaccacttctggtttagatagaatttcctcagatgagtaatacaaggatggcatgtgctaacggtttcaagatgatacaataagtctaaacttatttacctcactagaccattcagctggttaaattttacattctgctgaactattaagctaaaccattctgttctggcatattgattctgctggttaaattttacaagtgtatgatgtttatctgcatagccttgttcaaaatctttgtgagagcattcggtattgtcttgagcataaatgcttatcatgctttttgctatgattatgtgttgcttatgtagtttcttgttttctctagatatgggttcttgggaagagctagttaggaagtttttgttggaggaagaagaagacgatgaggagtttttctttattcttctccctgctatacttccattcctctctgaagagaaaagatctatccatacctcctctctctctctggtgcccagaaggttaaggagattcttgaagggcatgagagttggtgcaagtccgagtttcga

SEQ ID NO: 13048 - DNA, 726 bp, Zea mays
tggcggcgacggtggcggccggtggccggtggccggtgggagagccggagaggagagaggcagggccgcaacccgcaagcacggcggctgcacgcgcacaaggaagaagatacgagcgcaatagttcaggtgttttggcttttgggtgagttttcatttatgggccttttccgagcgtatgtgttgggcccgttttaaattcatgaaaaagttgggcctgcacaccaaggcctgtgagcctataaaatgttggtgcatctcgactctcgagaaaataagacttgaagacctaacgggccatccagaacgaatttaaatccatcaaaagttcaggttaatgcaaattgtgtagctcaattattagtagtcacaataatgatgcgttgcaccgtcaaatttaatacttataaaaaataaagttaatatcaaaataaatatatggtcacaatattaaggtataatatttgttcttatcaatttaatatctaaaatgccatcagaagtggcaagaccatacaagaaaaggcggatttttgtaagaagtgtttctgacctgctaaagtatgcaaagagggaaccttcccatgggagatcagcttctatgctgtccagcatattagagaagtcattagctgcttctcctgtacttaatttttctgtatgtggtgacagcaaaacttcttctgatgtcattagctctgcacagagaccgaaggaatcctatcc

SEQ ID NO: 13049 - DNA, 632 bp, Zea mays
agggaagctataaattttaatgagattgaagggatcaatataagtttcaatgacattgaaggaattttctctttttttttctccaagcatcgacaggtgcaatttgcaatccgatcaaactctctctctctctctctcacgtttcaagcatcacaagtctaaccatgaatctacggtgttctcagccatcatttatttattgataataaagtacaggttcgatggctaaaaagtatgacatggggccattggctgtggtagtactacgaccatgctacacgttgattttgctgccgacacggaaacgagtagcaggtaaacctgcatcgagccatcgacgacgacggggagccaagtagtacgagtaacaaacaatccaatggacgcggcgaaatattggcacccggcagcacacccccaccaatcccgtgtccccacgatccagatcagaaacgcaaaggacaatcgacacggacgcgacgcgaaggcgacgcaccagcaccacctaaaattctaaaaaggcagggccgtttccccgaccaccgcccgacgaatcagcgcgtccgctacaacgccggcgacccccgccggcgacgacccaccagggcagcgatccacgcaggcgaacaacg

SEQ ID NO: 13050 - DNA, 400 bp, Zea mays
tgattccgacaccattcatccagtttccatcctacaatttctcaaacgtgtggaggcgcctgcaattcgcccccagatatcaccccccaccccaaccaatttgatagaatagtcttccgaatctcgtcaacgtcaaggtcgagcgttttagcacgcaacccattttgtatggtcattatatatataaataaataataaaagcgacatgttgtgcttgtatgtttgctgtcttgcttcttccttatgatgaatccaatccgtcgtggagacagctaagcaggctttactgaatctagttgctatttaaccaggtgccaagcaagtgcagataccttccctgcctcacaaacaacgccatcagggtcttcaaccagggcaggttctcttctttcattcagct

SEQ ID NO: 13051 - DNA, 595 bp, Zea mays
ggtcttagctgccggagttgggtaatacctccctatatcccctattggtaggtccgccgctgctccaacctccaggtccaggcaccaggtcgctcctcccttctcttcccgtcgggttcttgtccatcgtagatagcctctccttcgccgaggtcaccagttcctcctcgtgtccttctcgctagtcgctacagtcctcctactctgcttggctcgagtggaatggggatccatcctgacctgagtggtttcttctttgcttggtaaggaacccttgctttcttggatggatctttgttctgcggattgtctaaatctcaattttcttcttcctccacgcaggtagtcgcgcatatttggtagccgcgtccgcgtgacgtcgtcggtgcttgggtccattcagacattgttcttatttgatcagtacccctatttagcgcctgcaagatcgagatcgatcttacttgactccataagatgtattggggatttggagtgccttgtactccaacttaagactgggagtgaacccgcataccccaagcccgcccttccaccgaactgaactagacatcctcaagcgtcatcaattcta

SEQ ID NO: 13052 - DNA, 862 bp, Zea mays
gactagtattgcaatcttctaattctagtatttatgtaagaccttatattacacttgaacaatttatgttgttatttatgcaaattttgaacttagtatttgttgaatttaaggtatgacaagaattttagatatatatttctttaacagaaccatctactgattttttgtattagattgtaccatattggataataaaactttggttaggcataccctggatttaactcgtgggccctccactgatggactgtacatacatgttgtcttgttcaaccatgatattgtcatcgtgtgcaatgtgcagttttagttttattatcagtatgagatgaatatttagctcatcagggatagctgaaatttcactaaatatgaggcacataaccttgatgccactaaacaaagaataatcacataacatagccactacaacaaaacgagtaatctgacatctcagtttttgcaacctacatattgtaaggccatgaacattggtggaattgaggcaagtagtacttgttagtgaatctcaaggtgtgatgttgaataaaattgttgtttttatattttcttacctctacttgttgtttgataccttgatgtctcccatgccatgctctatctcttctcgttatttgatgttttatcgcaacaattatttcctatcaattaattttaagcaatgatctaagatgttttgaccgaaccggatgcttcctccacactgataattgcaactttgatatttcatggttatgattctatttatatttgaagcaccaaacaagtcagctgatgcctttgcttttgcagagttctatcttaacggtgctgctagttatgcttgggtgttagtgcc

SEQ ID NO: 13053 - DNA, 1293 bp, Zea mays
cttcttcgacctacaattggggggaatcatagaaatcgaaaaggaaaaggcaaggacgacagctgtatcaccttggacgcctaggatccatggccgaggaccgaatcgaagatggggaggacgctggtgatgcgattcccttccttttctttgcatcgaccttcgctgacggaagtaacgactggaggtgtttgcagatggcagccttcgcatggaggcccgatggagttggtcttcggtgcctgacgacgctcgcaatgacctcagctacccgatcctgtctgctttgcgaagagatttgagccgtagcgatcggtgcgccaacggacccatcccggcatgcgaacacggtgcggatgcgaacacggtggagttggtctttggtgcctgacggcgctcgcagtgacctcagctacccggcgtgcttggcacatcgtgcgggggaggcagaagaggcggaacggatggggatcgtgggcgcagtggatggggcttctcagattctggcttcacgcgggcgtgggatcagggcgtgtggtggtggacggatcgaatggttgagattgccgaacgatatatcggacggttgagattgtataatggcagaacgacaggctacccttgccgtcttaataagtagtagagataatgtcaactgtgggaattcttatagtagcacactataaaactgtatatccgtttatgtttatgttgtcgatactgtggcaattgaagaaattgaggattgtcaaattgatttggtaggaaataatgactgtctacaatagagtttgaagattagaggatgttgaactatagatgacattatttatagagaaaagtttgaagagaattttgtactgtggagatagcctaactgtcatacggcgtacatcccagcagggcagcactagagacgatctaatctgtttggttgtgggacagccaggacagggacatcccctgtcgtcctctcctgtccctctaattttaagggacaacagaggacaacactggatagtcctgtcccaatccttgtcccagaaccaaacaatctaattttagggatcgtcccatcctatcccgtcctgtcattgcaaccaaacgcaaaaaacggtgacaaaaatcttgaaaaaagcaacgttgtgatttgtggaatgacgtggctctgtgatgtacactgtataataaaggggccacccatcaggagagacaagcaaatttcccaaacgcaaaaccgcatcctctcatcagcttccttccacattcgtctcgagatctcgccccgtcgcc

SEQ ID NO: 13054 - DNA, 626 bp, Zea mays
tgtagagtcgacctgcagaagatcagtgaggctttccagaaatgttactaaacagcccaatgagaattgaatacattaacgttaggtaaccaaacagatatcgctttctgttgcactatatctgttagcagatatatcagccctaggcttcctgccatataggtgcaggatctcctgccatacaggcgcaggcatacttgccttactggcactgccgcatatatatattatagtctataaatgcaatcctcccatttagggggcagcgataggtttccaccaatcaaggagatctcagggtattgtttctataaacctgagatctcctgcccctctgctcctctatatttatgcgcctgtattccctcttctaataatcaatataaacagcaaccatattgctatcagtatccgatagcattgggatttgttcacatcacgttaaccactccctgcaatgaaccaaaaacaccacctaatttctagcctaattgctctttcattttgtttgcaggaagcctattcgagacaaggtcgatctttgctgccttggcgagcttcagccgaatcaaggtcgagcatggcggcaggccagtaaatagagcaacacaaaacccttcaaatca

SEQ ID NO: 13055 - DNA, 68 bp, Zea mays
aatgagataacgtgattgtttttcatcttgacgcgtggagctcatgtttgataactacgtctagttcc

SEQ ID NO: 13056 - DNA, 1500 bp, Zea mays
aaacaaaattctctaaatacgagctgtgtgattgtttaattattaacttgtttttttttcactcactcgcaggataaatttcttagcaaaagttcagactctattaagttatagtaatatctataatgcaagcaccttactttaggtggtccaatgaaccggggttttttttgcctgtagcataagtgcatgtatcatatatgttgtgccgccgatcttcgtgagtgaatcttaattcttgaaagaaaatggtctcgttgcttgatctcctggattacttagacatcgctagatttgaagctttccataacgacgcccgagatacctcaattcactcttctcttgttgagacatagcgtagacactcacatgccgtagttaacatgttacctctaatcgattgatccaaaacaaaataggcccggctgctcaacgtgtgtcttctctccagcgaccagcaggactgctgcacagatctaatcaatcgatcccaaaaaaaaattacgccgcctgttcaagtgttcagcgaccagcaagattgcacagatcagaaaataaaaaagaaaaaatatcaaagccaggtttcgatcctgggacctgtgggttatgggcccaccacgcttccgctgcgccactctgatttttgtgttagactagcagaattaatgcaaaatttcctgttcgggatgggtgaacggccgctctgttggatgtttggatggacctgtgggttatggcatgccccctcctcacggtaacccttcctgttcaaggagactcggcagaatcagacgccgccggagtcttctaggcttcctcgccccttccacatcgccggcggcatcatccttgcgccgcccggccagatcacagccggtccgccgcttgcctggtaagacgatctgttgcccgctgggaccaagcagatgtctttaatggtttccctacaacagttaggcggcggcggtagtgttttccattgacgcccccgttccgattgatgaaccaaacaccacctacaccgatgatgatatcgtatcgtcgcaatcggtaggtttggtttctttgctcttcactgaacacatgatagtggaaggataagtggtgcgcgtttatatacgaagctgtgggcgtagctccatacatgatagtccatagtcctacgattttgcccttactattctatcactgcgtctgggccccatctcttacattaggaccgtgccggtaatttggtgtcctgaattcataacgggtcggctataagggctggataagaatgtggcaactgtagtttcttctcgtgtttgcactcccctgcccggctgcggctgcccggcagggttaggaggcaaggtcgctacgtgagcctgtccgatatatctcccgtgttgccgtgatctgaggatatgttggtgtgtgcatcgtgctggtgaatctgactcgtttttccgatctttgaatttagtagggaagagagggtggaggaagtgggggagg

SEQ ID NO: 13057 - DNA, 460 bp, Zea mays
ctccatttttttatttatcgatgtttagtttaaaaaatgaaactagaacggagttgtcagatgatagattataaacacgttgaaatgtgcacaacgacagaacggaatggaatggaacggagcggcccatcgaatttggttgacgctgccactgggcaggtggggcactcctcttccggtcttcccagcgaacaacccgtgcgccacggcgcggcctcgggcccctcttcaatgcgcgcagcgtgccctattgcgcctttctctctcgcatttggcgtttgaatcattccattttccagtctgcactctccagtctcctcctccttcacttcttctccccgtcccatttcttaactccccgagcccccaaaatcacgcacccagagaggggagaggtggagtgacgggggagaggcggaggccacgccccaaacccaaaccctagccacacgcgacgccg

SEQ ID NO: 13058 - DNA, 1247 bp, Zea mays
tagtgattaagtgcccaacatggttaattaagttcttatgtgtcaagtaaagtgagaagtgcaaatcaaagaaaaaggtacatttctagacttagtacattgttttgagtactaatgtgttttgtctaagtgctagaaacagcgagagaagaattggaaaaagagttggctatgtgcagcaaactccagctcggcttggcacatcggactgtccggtggtgcaccggacagtgttcagtgcgccaggctggtccgtggtgaactcgccgctctcgggattcgacagcggcgtacggctataattcactggactgttcggtggtgcaccggactgtccggtgatccaacggtcgccagcgcaacggtcggccgcgcaatcttcgcgcgacacgtggactgctccaacggtcagctggtgcaccggacagtgttcggtgcgccaattagccgagatgagcaacggtcggatatgccaaatttggaaggagatcacgcaccggacagtctacaggacatgtccggtggcgcaccagactgtccggtgcgccactcgacagaaggcaaggatggccttccaagtttgtctccaatggctcctagctgccttggggctataaaagggacccctaggcgcatggaggagacacccaagcattcactaagcattctaagactcccgcactccgcctccgtgaaattgatcgactgtgttagtgatttgagctctgtttgagtcgtgaactcactgtgctacgtttcgagctcaagtcttagcttgtgtgcgtgtgtgtgctgcggatttgtgtcttgtgtgtgttgctcttcccaaccttactccgtgctttctttgtgatctcgattgtaagggcgagagactccaatttgtggagattcctcgcaaacgggaacaatactctaaaggaaaaatcgtggtattcaagttgatcatcggatcacttgaaaggggttgagtgcaaccctcgtccattaggacaccacaacgtggaagtaggcaagtgctacttggccgaaccacgggataaaaatcgcgtcttgtgttgctttctctgtgattgttgtgttcacaagaactcgcttcaagctacttagccgtactaacacttataactaatttttgtggctattagtgtttgatttttacaggatcaactattcacccctctttaggtgctctcaattggtatcggagccgtactctacatctaagggtctaaccgcccgaagag

SEQ ID NO: 13059 - DNA, 697 bp, Zea mays
ggtaccctggcggcgtatccatgttcaatttgcaagcgtgcgtcctcttgcattggcgtatagggatagatgatgtgctttcttcttgttgttggtggcaactgatggtgacggacacacgcttaatggtcgcaactagagcagaccgtcttttatttgtaaataaatgataagcagcgcgcgtgcacggcccgaccatggcaagaaaatgacaaggaatcgcgcaccaaccgcgagttttcattccatctttcttcatcctcctttggttttctactggcatgcataccaccagttgctagtgtgctacctatcgtgcacttccactgttccacatttgtgacctccattatcttcttcctcatcaattaatttaccgtggagcagtcaagatgagacgtgacggctgcactgatctgcaacaagagacggttgttattacagccgtccgtctggtggtgcatgccattgccagccagcagcattgaactgagtcctttcacccctgactgatcgaaccggcaccgcgccgcgttgggtcctgccgatgtcgttgccggccgtgcgcagcagcagcagcagtactcgagtctaatgcaacttcgccgcggcgcctcactagctatgctgcgtatggtggacctcctcccgaattaaccactaataatgcaacgcgcaagcaggtgagagcctgaac

SEQ ID NO: 13060 - DNA, 1500 bp, Zea mays
tcaagtgtcaacgaaggaatgcgacggctgtgatgtagccatgtaggtccccaacccactggtgcctgccactctactaatcagccccaacagatcgcattcgtcagtttaatatacaagacaaatttgttcctgcgactttctacttttacaagatcacaaagttataaccacagctttttttttgcattaccatattacgatataaaaaaaactatatcaccataacgttttatcataatttttaatatggttttgttacatgattttatagataatttatcatggcaaattatgtacgcgacatttacgaccctgttttggttcataaataaatgttggcagaagaaattatccagactatttctcagcaaaaaaaaattctaactaaactttgacataatattttttatgaataaagtagcttaagcgtttaacttttttgtttctcaacatcttgcaaatatacacaacatgtacagcgtatattttttacataatttcttccggaaagcttctataaaaaacaataagaataaatgagaagcaaagaaataaaagaggaagaaaaaagagagtaagaatacaaaatcaggaccgaccattcgccaaccgggtggtaggtggcaaccaatcagggtgattagaactttagaagtgggtgccactccactccatctccacctcacttcgctctcaatttaaatttcggcgacgtcctaacaaactgttaagcgaaccttctataaaaccatggctagcactagcagagcccatcaggataccaccaacaatctttatggaacgagtaggggtggtcaaaagaatcaaaagtatatataaaatcgtctcgagcaacgtcttctatatccctactctatatatctcttttataatctcctctaaaaaatcttaactctatatctcatctctctccaattgttctcttcatctcgttttctatacgtaaatatgcgtatattcaatacattttgctctaggttaccgtacatacgtagttgtcatgtcctcaaatttcttaaagtattaaaatggatagagtagagtagagaaaaactctatatacgaaggaaggatagagaaatgtcctatatatttagaaggtgtttttagaaaaataaaaagttatagaaaagtacagggggattaatatttagagaagagaatctttcaatgagcctaactgggtgataggtgagagtgagacacacgactccaccatacccacacttcacctttgacgacccaacaactgcgaacaaaccttctagaaacccactgcgtagatgttttggccaatgacaggtggggcacgcctgcaattgccaaagctggatcggtcggtgtccttttaacgtgaacagaaaaagggctcgctcaccaacaaaagaaggaccccagtaccccactaaagaagagaagaatgtggcgtgaacagagagacctgaccctgaggcaggtgaggaggtccagggagca

SEQ ID NO: 13061 - DNA, 278 bp, Zea mays
ggtgagcgcgcgcgcgtcagcgcctctcgtctgtctcgtctcgtttcttcgttgcgcacctccggttgtgtgtgcccttgcgtgcgttcgtgcgcgcgtgtatgtgcccagatctgtgctcgccgcgccctagatctggggcgatccggcccggattccctcgctcttcgccattgctcttggctgattgttggcttgcttggttgctgctgcagagtactactcgccattcctgggcatagagaagggcgccgtgctgcaggaggcccgagtcttcc

SEQ ID NO: 13062 - DNA, 1500 bp, Zea mays
cggccgagtgaagcagccgcctgccagccagccatcgtctctgcgctgcttccgtggcccggatctgggagcgcggcgctgacaggtgaccggatctgaacctctctctgtctgtctcatttgttcccatttcggtcgattcattcagggccctgcgacgcctcgccgtcgtcgctgcctcctgtctgtggatttctaggttcttttgtccctctcctccttacgcgtacgtggtggagctctaggtttcccatgcgcgtgcaaaatcccctcccccccgggtgatttcgactccagcgagtcgcgtcgctttcgagcgtccgagttcagcgcggcgaggcggcgacaaaaaaaagcgcgattctttttactcggatacgaaacctttttggcacatccttcgaattaactaatcgctccaacgcgcgcggattttttttcaatactagattatagtatatacacggcctactatgatgtcatacctgcgcttgatgtatcatcggtaaaaggtcctcctatgagtccagaaagtgaagttttaataatccgtcttctgttttcttgtcgacgtcagctgtgggaagatctactctacctaacaccggtgtcagtgtcaccgaccagggcttctgggtttatattagcgaatttcccctcggccttttggcccccagaatctgttgtgaaagggattttagtccctcgcatagtcgcttgatgtggactgatacgtgtttaatgacacgatcgaacaagtgtctcttcttcttcttcttctttcttttcttttccttttttttttcaaaaaatgattctttcatttgttttggctatgataattgtctgttctatgaatccagctgctcaagtagccatccccagttgctaaaagcacactgttttgtttctctgcagtggagtacagtggactacgtcgtcagctgcaatacttcttgatccagatccaggcgtccttccaactcttccttctgcattcgtgtggagtggggattcttctggcctttcgagtgacttcttttctttaggtgagggagctcttccttgcttggagccttggactgtctgagttttgctttgctatcatctgtcagccctcagctgcaagcatttgaatctgggattgataaccgcccagatttttgcttggatattttttgctgcttgggatagcactagtaccaacggtgaaaaatggcagtatttaattgacactgttctggggatttaatcttgttcgacttggactattactagttttggggcatgattggaaaaaaatggctgtatatacctctttgatatgattatgtgttcatttagcacatcctgttacctgtttattgtcatatgtattattaggctttggcattccttttttcttttgtttgatgcaagtttcctatgtccaggcaattttaacaatttaatattttcatgtgcaatgcagtattgtgagatacaacatcagctgatcca

SEQ ID NO: 13063 - DNA, 1500 bp, Zea mays
caccactttctaaactctaaaccatgcaaaaccacttcatctttttctgcacgcaagtctcgcgatattttgattctcataacaattagattatttagtaatccatattctaaaaaaaaaactgtcccaaacagacacggtcacaccgagactactctacccatccatagttgctacagtgctccagcgtgatatgaagagactagtgcatctacgacgggcggcatccgagttatcaagtcaccatctgcgatagctcatggagatatttgtatgtccaaattcggtatgagtattggtctttctattgctctccttccattctagaatcttttgtttttctagatttatagttttcggtatgtacttattacatatagtgtatagcgtatacgtaaatatatatcataaatgatatatctaaaaaagttaatacgttttataaattaaaatagggaaagagttttatctagatgtaactcatggaaatatttatatgtacaaattcgatatgtaagccttggtgggggttttcccgtatttctgcaaccaacattacaccgatatttttcaaacttagatgtggcatggaggttggaggataccattccacattacgccatttatgccgtggtccatcactatgtacataagaaattgtccatcaaatccgagacccttgcttatttttggcccaaaatctagcatttgtagctctgactctcacaccgaagtccacgccaacgccgacgacgtagacaaagccgatttttttcgcgagaggatggccgcgcaaaaatctcccgaattccaccgaactgaaagagggcgtgtggggccgggcggggacggacaagcgcgcgtatggacgactggccgggtagcgacagctcaccgcccggccgcccgccagccagcggctggcatgtcagtggcattggcattggcatagcgtggcatggcgagcgagtgggaaacgaacggatcgcgacggcggcggcaacggagcgccggcaaccgcgccgctcgcttttcgtcgggcgcacgggaaatcttatcggctctgtggggtgcagcccagcccatgcccatccatccgtccgtccatcctgaacgaaaaatgcccgccgcgctgccctcgtctgattgtgccctgcagccgccgctctcgccgccgcccgtcccgacttaggccaagccaaccgcgtcatcgtcttatctctctcccatcattcatctatctgatctcatctcctatcttccctctctctcctccccgtcgtctgccttctctgcccggcaagaccgcctgcccatgtccgtggcgccgtgcgcgcttctcctgccctgcaatccgcttcctcagcgcagctccgatccgccaacgccgcccaaggagccgggatcggccgaccgatcggagacgagaggcaggcagcggaacagagcagcggcccgcaaggcgattgctctattctgccctgttccagcgttccatgc

SEQ ID NO: 13064 - DNA, 1500 bp, Zea mays
gtcgacgtgtttggttcttgaccctgtatcgcctatatccttatctctcgtgtctgacgtagagaaacgagaggcttgcctagaccggtgaaccaatttggctcactcgtcgcgaaggaagccaaaccttgccagcgcatcacgtgatgcgtccggacaaaagaactagacgtgtcccgactaacctccccgagtcaaaaacgtggatgtggattcttgcttgtcatatttagcgaaacggttttcgccactaaatgctagacgcgaacattttgtcgcattttagcgggtcggttttcaccgctgaccttttagacgtggattccttgtcgtatctagcgggccgattttcgctatcaacctttaagacgtggattttgtcgcattacgtatggcgctacccgtgggcgtcgtgatatatgcttgaataagaaaagtgtcgtgtggcattgagttacatggtgcggcacaagggttattgtgtttagcttgccgtgctagcacctgctgatgaaccgctatctggtattgatatctttagatgcatatatgtttatatctctaaccacagccgcaagaaatacccgccctcctagctatcgattagagctaatttttggttatttaggacatgtacaattgtagtcgtttatggcaattaggttgttttctatcagcgtgaagtctgcgcaaaccatatcaggcgcttggagaagtatgcgatgctccgcgaatcagggatcacagacacgaaagaaacaaatgcaaccatgttaaacgcctctaaaacaaaactacctgtaaaggtagttaaaaataaaattagtaaaacactcctcgctcattctggcactgcagcccgatcttattactcagctgtacgtataaggaaaatatgtggtgtcacttgtaacagcatggcaagttgaagtgtttgaccgacgcaccgaaaaaaacccaaaagtccgtgtgcgcgaagcattgtggcgctcggctgcaccccgttgtccggcgcccccactgccctaatcatctgaccggtttgcggggccttgtcgtcccccgacggcagcggctgccgcctgccgcagcaccactttattgcccccgaggcgacacctgtcccgtcgcgcacctcgccgccgggatcgtctccctcaaaaccgcaccaacccccccaccccaccaacgctcgagctccacatcccccgctgcttcccctcctccgctctctttttttaacccgctccgttgaactggatttcctctcgctattgtggtatactgtagcacgccagacgcaactagtcacggtcacggtcaagctcattgcgagcggagcgccctcctgtcgcttctgccgccgccgccaccgccgccgctcggctataaagtcgccagctctgttcaccgccgcttttcctctgcatccgtctgtggtgcggaattgaattccggtgggatttgggagccgagaggagaaggcggtaggcggggaag

SEQ ID NO: 13065 - DNA, 58 bp, Zea mays
aagattgcaatacatgctagaagtagaggactagagtgtataattttagtatgcttgc

SEQ ID NO: 13066 - DNA, 777 bp, Zea mays
ctaaatgggttagtttttacagagaaatttgtcagatactattttcaaagataggtttgaaaatatttttttaaaaaaaatccctgcaggtaccttcgcagtgttgcggaccgaaaatttcgaaaatttccggactcccgaggacacggctggatgcggacttgcggagtcaggcagccgcagcagcatcgctggttttgatacacggttgccagccatgccactgaccgcgggccgcggcagcctagcgccaccgcgattccgacttccgagtgagaccaactctgacatcccatccccgacaacacgtggaaccgccacaaaactaatcgtcttttggtgggtcggcttctcgttctcgcgcgcacccccgcgccccgccccgccacccagaagtccacaccgccagcgacagcgaccctcatcagctcagctgctccccctctgtctatatatgggccttgtctcacactaatcctctcacataattagccaccgccaccagttagccctctgtcctgtttgacgaggaggagaaggaagcaaggaacaaggcgccggagggggaagaggaactcaagctccggcaaacagcaagcccatatacgtacattgtgataggtgagagctacggatcgaggctgcctcattctcccctcttgcatttctcttcctctcgctcgcgctccaaatcttcttcttgcgcatcaatcggttgctttgctgcacgcggtctcctgcagccgctacaacaaggccgtcgccgtcgccgttgcc

SEQ ID NO: 13067 - DNA, 1227 bp, Zea mays
caaaaagatatagaaaccaattttatgcaaatagcccgataaatggtaatttaaagtctgtttatattatctaatcgaaacttaagtttttaattaaagctctatacaaacaatctaaggggatgtttggtttataaggactaatttttaacctctacattttattatattttagttcctaaattgctaaatatgaaaattaaaatagagttttagtttacttatttggcaatttaaagataaaaatataataaagtagagggactaaaaattagtacccattaaactytaaattttcctcttatttttagtctatcttatattagagagcttaaaaactaaactaaagtgctttaaaacttttagagatagaatcactttataattattagagcttgaaagtttagaagagaaaatctaaatagttttcattagaccagagtaagattttagaagacttctggcataaggacgtgagggccacaccaagcaaccagacacgccctttggcaaaagggaaaagcgccactttctccgcttcttttttatgatcccttcgtctcttctcttcggagtagttgggaagctagagaatcaaacgagattggtgatgctaaaatctactgcttatttaattttaaataaaaactaatttgataatcctatttttaagagatttttattttattaaaataaaaataaactaatttatttttaaaaataaaaataaactaatttatttttaaaaataaaaattctttagaaaaataaaatggtcaaactaaccttaaaaaagagattttattctctctaattatctccggtttttggactagccctttgtgtcccactcgccacccctatattctctatttctctctcccgcgttctccacttctcgtctccttccttccgcttcctccgtcccctggcggcctggcccctgcggtttctggttgtccctcacgccaatgtagcttgcccctgttttgttgctttgaccaccttaaaaacctcagggccttcaaatatactcaccgaatcacatcctgtcacgcctcctgctcaaattcctaacgcccgagaaaccaataaccctggtggtgaggccgctgggcaacgccgtcaccttcacctaatcccaacttccccactagtcctcaagtgtctctcttcttctcttcggttacaagagcagaccggagttaccgggcggtggaggccgcg

SEQ ID NO: 13068 - DNA, 288 bp, Zea mays
ataagctcttcgtgacaattacgacatgaagatctctctagcaatcgttaatttttaaaaaaaaatcttcgcgcttatcgtagttgttgcatataaaatagattcatctcgtgcgcatattatttacattgtttggttgtttttactgaatcagctcacgtgttttgtcgtaattctgaaggttgattttcatactcctctctactggacttcggctgcttgtgcttctgcgcaatggctggtgataacaagagcgaagaggctgcaattgctaagttttgagaggct

SEQ ID NO: 13069 - DNA, 776 bp, Zea mays
cgaataccagcacggcagcactgagtatagagggtgacagatgaggcttcgcctccagcagagaaggcgcggaccagtgctgacaagtgacaagacgcgcgccacgcacccgaatttggagaacggcgttgaaccagatctgacgcggcggcagcagcgcgatctgcaatctgttggacgaataaccggtggcggcggtttccgaaaaaaaaacgtgtgtctaataatcctagctctatattgattgttaggatcgtccgtgaaaaaaaataaagtttaacgtggaaaaaactgctacaatatagaggagaaaaaactcggaaaaatagatttattacgtgatataacgtacatggtacaaaagaacctatttatataggcgaagaaaataaaaatagagtcatataatcttatccaacaaaaccattcaatctagataagctgatgcataataagtctattccaaaaaattaataaaatgaagttatttctcgtatcattattaattattagactatgagaaataaaatagagatggatcaatttattccatccttcatttctcaaacggaacaagctaagaaacatttttcaaaccaaacatactataacagatataygacggaacacaaaataatgagaagacaccctatgataatttgataaaggacagggataggccgggcgcgaactgttataaatacacgtacagaaggcacgaaccaagctgtgaaatgaactagaccaatttccttgcagagagtactgttttggcg

SEQ ID NO: 13070 - DNA, 928 bp, Zea mays
tcctttctgtaagaaaaaaactcggccggggagggaaagaccaccatctcggtattatattaagaaaagaccgaaacaatggtcccggccgagaaaatccccgaaccctgacccatcactaacgggccggcatcaactgtccactctacaacagcccaaccggcaggacatcgtaacccgagagtagatgggacacagcgagaagattttttgaaccaagcctggaaatacgctctcgagggaaatcaaacctaggacttggaggtgccactcggaagtccttaaccaccaggctagaggccctttcgcctttctgtaagaaaggaaaagaactcccaaatggaggctcaaaaaaccttcccgacacatccactcactaaaatttgcgccactcaaacaacaaatggcatactattagttttaaggctcattttgacgttgaaatgaaaatgagcaaaattcaactcttgtatatttcaagtttttttttctcaagacagaagctcgtaaatggtaaagcattaactgtgtgatgttctttgtgcagacagtgaaaactttcttggaggagactcttgacgcaatatcggacagcgttcttgacaagccagtaaacagggaaccatccagtgacgaagaatattttgctagtgtcgattctctgttgccaccaaaatacacgacaccgatgcatgaaagacttgtagccgcatccacttgaacagcgtgtcgggaagcggattgcctgcggtactgcagggtgtagttgggtcactgcgcgtgggccctgtcgcacggggcagtgcccacgcagggggggctgtgaaaatgatctatgtaattgttgtaacacatatacgtcgccacgtcggggtatatcaatagctgtagacataaccattttgactttgcggtaaaatccttgctc

SEQ ID NO: 13071 - DNA, 393 bp, Zea mays
atctatgaataattgattacttcctaactatagaatgagttgctaacttactatattggtccttgatgtacatattcatttgggtctcaactgtttgtacactgaaatcatttgtctgctgtcacctgtcagcaattaagctctgaagaattaaaacgaactggttcatctggctgttcttgattcgtgttctgctcatgctcccttgtttttcaaattcaggcgcgagagattccttctgacgatccacgacttctcaatgttacccgtgttttggacaacctgaagctccgatttggaccaagaagaaacactcagtaacttagaaacaatattgtccctgatacgatgcaatcagtaatttgtctttgttaggtttctggatgcgaaggc

SEQ ID NO: 13072 - DNA, 56 bp, Zea mays
agagataggcaggccagctagcttcttgtagctaggtctcctggattactgtgaca

SEQ ID NO: 13073 - DNA, 101 bp, Zea mays
gttgccgcggctctttgacgttgccggaccgtccatcggaacgcttcggaccgtccggtgatgttacggaccgtccgcgcctagacaccggaccgtccgcg

SEQ ID NO: 13074 - DNA, 886 bp, Zea mays
gaaaaggaaccgacttaaagggataaactatcgaggactagacagccttttcccctttaagtcgttttaattttccatcgctaagccgaagcttttcctcgggtagcttcggcactggttcatccttttctcgaaccgcactcttcatatcatgtataacttcatcctatgtccgaaggtcctaaaaaacatgatttaacagtgtttctagagtataatgtgtgaacaggtatcttcggactcgtatcagagagggagaagctcaaaagatacgaaggttgacacagtgccgaagctgtgaagcaggaaagcttcggcatgttcgcagaaaaaggaaccgacttaaagatgaaaaggccatttggacctcgatagaatgctatagaattatcaccaaatgtaaagggcatgtatgtaattttgtatgggttgtaccccgtgcctataaataggtgaacagtatccccgtactgttcacgctgacttggcattcgctttttgcgtcacacttgtactttcatctccttccaagccgaaggtacatttataatacaatattgtttctatttctctatgataatataacaaagttaaatgaataatattatatgaatattcatgttatcttttatgttttatatgcttcgtcttttgtatactgtgatgaagaaggttcgtccttcgtgaccttcgtccggagatcgttatatcctaagggaaataatgcttcgaaggacgaaggactttatcgtttaacattttctgtgttgccttgttcttaactcatagcatttgagaacaagtccccaacattggcgcccacctccggtgaactcacttccacttcttgagcttttcgacaccttcggcaagcatcagcttcgtc

SEQ ID NO: 13075 - DNA, 165 bp, Zea mays
ggtgagccttttcttttacttggagtgagccatgatgacgatcgtgcgattgacccatggttgttatagtctgacattaaggatgagcaggtgaggattgaggcgttgggactgggatgcaaggtcatccaatggaacggctatagggtctccggtatacttgct

SEQ ID NO: 13076 - DNA, 1421 bp, Zea mays
cgcttggatctcgcgtctcgcccgacaaactatacgcccaactgccaaagcgagcgagcggccctcgtcgagtccatgcatctatgacgcgggcgctgggcgcacgcggacgggaccgcaggcgaaagccaaaaccggcctgcttcctcacacctcacacctcacacctcgcctgggcgactggcgtcgcgccctctataaaccaccactcttctcccccacagcactctctccctcccatcccctccctcgtcgtctcgccactcgcaacaccccaaaaacctcacgggctctcgacccctcgcgctcgcctcgtcgccacgccggcgtgaggggcgcccacccccgtgcctatataacgctgccggagcggaggtactcgtccctcttatcccgtcgcccagatctaattctgtttaacgccttcgtctccgcggcgtcagggcgatcccgccgaggtcaggttagctcctgccccttgatccgatgcgcacgtttgggttcgtggcggcttgggtgcgttagctcgcagatctgggcgtttaggaccgctcctcaccccgatctatgcgctgtggctgtggcccgcggttgattcgacgctgtgcagcctgctcccatcggtgtccgctcgccgaggctggaattctccgagatcgcacgtgtttatgttgtgccagtgtcagatctgctcatgcgtggacggtcgcagctctgcatgtctgttcctgttgctcggcgcagagggtagatttagcgcttttggatttggatttacgccatctctgcgcattgctgagctgctctgcccgcgcttttgcgctgtcgtagaaaggtgtctgggttgggtttgcgtgacctctggcgtgtgtggctggacttttgcgcgtattgggggctagctgtgggccaaatcttccgtgtacaaatttttccatgtttccctttagagaaacctgctcgtgctgagtaattcctgtgtaaagataaaagcatgatgtcatggactgagataaaagcacgatgtcatggactggcacctgtgcgcttgcgctttacattcttgccgcgagcttactgatgatatttcagttcccctttccataagtgaaacagctcctgccgtgttggttttaattgtttgacaagtggactgactggtgtcgtctgatcataaaatatgattagcggaatactttatattcaaagggaaatatttcatgtgaaaactgagattgttccacttaaatctcatatattttctgttttcgctatcttagctacttatgaaaggtaaaaatcgcaaatataggaaaaatgtgagttgccaaatatgataggaaacaaaacttaggttaggtcacaccatctaataataaatgaccatctttccttttgattgcagggtataagctggtatc

SEQ ID NO: 13077 - DNA, 809 bp, Zea mays
ccagggactctctaaccctagtgtaatagacgagctctatcttcctactcttaagctaacttatcatcacacaatttgtggatgcttatctcggaacgctcccgcgcggggacacgtccttctgctcctttggaccgctttttgtggcccatcctgtgttgcagactgtcacgggctcgacttaaatccggtgataaatgaatcttcctgagtctgccttcatttttattggaggagcaatcgaagataattatagcatgtatggcgctccacaactttattagggaaatgtgattcatgattgagacttcgataatgtggacatcgatatgcatgttcatgaggtaggagtaggagagagtagtagcagacctgcaaataagttagacacgagtgcatttagagattctattaatacagtgttagtttcatgatatccacatgttatgagcattgttgtaatggagaacctattgacacatttctaattgctagcaagttagtttaatgtacgttgttttattgtttcatcaatagaatctaatcagccatcttctgcctattcaaatatttagattctaactaccagtttctcactacaactatattatcaagcattcagttttttactataatttttctctacatccaacttctcctcgtagtcatcttttcagaaaagtttcttagacccacaagctagagccagccagccgctcagccccagccctcggaaacccatcgcaaattcgcaaactaaccccaaaccccaatccaccccatcccctcctcatccactccgggcggcc

SEQ ID NO: 13078 - DNA, 1500 bp, Zea mays
gagacagatggtgctgatgaggatagctagctagagagctagcgcggatggctggatggatgtgtcttgggtcatgagagagagagagggagagagagagaataaaaggtgatggctcaaaaactgagaaggccgtgacaaaccctaggtatggctagtagctaacagtaggagaaagagagagagaagagggagaagaatgaagagctcaatcagtgtgcaggaggggacatgggcggcgccaccagagaaagctgggaagggctccagcacgcaatggaatggggtggactggggatggatcggacgcgaggaggcgagatggtgctgctgctgccccgtatttatacacccaccaaaagccaaaacaaagcgaaagcgaaagcgagctggtctgctcttggtacgctgcctgcggcctgagcttcgcgacccaagtgttccttctctggggcccacaccgagctggtagaggaagaattattgtgttcttgtataaatccatcattaaattaaatatacttatcataaccagatctaaatactcaaagtagatttctcatattgtaggatcggatggcgctagaataggcaaggcattcagaggaggtgaacaattgcggaagcttaaaactatttatctcagcttctcttaatcacaaaaccaaaatattgcagttttatagttccgaacagattgctgtcacgttaaaaaaacgttgctggccaaaatccgtaactccgatcaatctcaaaatttaatagattaaactagatacaattatgaaactaaaccaactaaaatcacgtcgatyggacttccggatctaaagttattaacgaaacaagatcgctggtctagagagtaatgaaaactaattaagatataattttggaattaagcaattatgagaaaagattaatatctcaaactttgtagatcagtaaataggtactctagcaataatcttgatgatttttttccgaaagcgtaggagagctacggcgcatcatatatatgaagaagaaaaaagtctaaaatagaccattacaaaaaaaaaacagaaaactgaaaaaactgaacagtggccaaaaccagctcatggcaaccgaaagcaacaaaacataaaaacatccaacattatagctaagagagactaaatccctggaatcggagccataagaagggccaaactcttggccccggctagctcccaaagctccttttcttctccagcccttctgatagctgcatccaggtttggggaaaggccgtcaaacacacaactgtttctgtggttccaaataatccaaagccccagaataattaaggagttaaaccctttcttggcgattccatgcagctgatcgctgcagcttttccaccactgcatggtgtttccctctcccatttgaggagtgagaccctcaagattaacctgtccaagcagcctgtaccaaaaactcctagcgaaaacacagtctacaagcaggtggtct

SEQ ID NO: 13079 - DNA, 1396 bp, Zea mays
cttagctataatgttggatgtttttatgttttgttgctttcggttgccatgagctggttttggccactgttcagttttttcagttttctgttttttttttgtaatggtctattttagacttttttcttcttcatatatatgatgcgccgtagctctcctacgctttcggaaaaaaatcatcaagattattgctagagtacctatttactgatctacaaagtttgagatattaatcttttctcataattgcttaattccaaaattatatcttaattagttttcattactctctagaccagcgatcttgtttcgttaataactttagatccggaagtccratcgacgtgattttagttggtttagtttcataattgtatctagtttaatctattaaattttgagattgatcggagttacggattttggccagcaacgtttttttaacgtgacagcaatctgttcggaactataaaactgcaatattttggttttgtgattaagagaagctgagataaatagttttaagcttccgcaattgttcacctcctctgaatgccttgcctattctagcgccatccgatcctacaatatgagaaatctactttgagtatttagatctggttatgataagtatatttaatttaatgatggatttatacaagaacacaataattcttcctctaccagctcggtgtgggccccagagaaggaacacttgggtcgcgaagctcaggccgcaggcagcgtaccaagagcagaccagctcgctttcgctttcgctttgttttggcttttggtgggtgtataaatacggggcagcagcagcaccatctcgcctcctcgcgtccgatccatccccagtccaccccattccattgcgtgctggagcccttcccagctttctctggtggcgccgcccatgtcccctcctgcacactgattgagctcttcattcttctccctcttctctctctctttctcctactgttagctactagccatacctagggtttgtcacggccttctcagtttttgagccatcaccttttattctctctctctccctctctctctctcatgacccaagacacatccatccagccatccgcgctagctctctagctagctatcctcatcagcaccatctgtctcttgctgtctcgcagcactgttcttagctgcaggtagctccagctcgatcgttcgttctctcttagcagctaaggaaggccacataaattataaaaggcagcccttgagggcaggcgcaaggaaagctgtggtttccatctcctcacacccttctccatcgttctccctccccaagagtcacggtcagtaaaaggaacgaaagaggccgagtcgttctcttaacttcgccaccgcacccgccatc

SEQ ID NO: 13080 - DNA, 262 bp, Zea mays
tccacatgattggttggtgtactaagaagcgtatggcgcgagccagcctcgtcgagcagagaagctcgctctctggatctccacgtatgcaggctgaaggtgagaaatataactgagttgtatgtgtgtgtacgaactcgggtcattacatgcaggtaatcaatcacaagcacatacggcgtgattggttgctttctcgaagcagcctgcccgctcgggccagcttccgttgagcctggccgcccagagacggaaatgaatc

SEQ ID NO: 13081 - DNA, 1267 bp, Zea mays
tgtttgcactggtggatttgtagagatgttatcattcaacaatgttctgtggtcagttgccattgtccttatgctctgtgaataatgcttggactgccgcctgtgtatgatttggtttcggcttgaactttgttgtgtgtgaagctattcctaggcgatgcttgattatatccacgagatacagcagacagtgctgaggtcatcgctggtatcacaacgaaggatgattcttgtgagatgctcgcgttctgggttcaagtcagctcgcagcgaactggaatctgaatgcaaagcaggcctgcgcacgagcctgattcggttggcggccagtcggccactgctatttgccaattgccatgtgtcgtccacattgggagtttgaaggatgggcaaccaaatgagcaacggaaaccattttatttgctctgactgggacctcatccaacaaggaacgacggatgattccagcgcttttactcgatcgtcatttgactggaacatctccggggaagggaccagatgcttccctttttttgtagaattcattcaagaaggccattgggtcaccaatctgtagaattcacagttcacaaaggccatcatcacctagccgttgaatctggtggaggcgcgaagtttcatgaagggtccagcatgttcccgagaggagcttctgcttctccatcacaactcacaagtgacaagtccatggccagccaaggtttcttgcactgccttccctttccttacttcaccaccaaaccaaacgtgccaaactgcagaatagcagcttcctggcccctattcctctacgcagtctctttcgcatttcccctaataacacatggactgctgtagccgccttctaatgacgggaagacagacgagatcccgtcgacgtcacatcaaggaggatgtgcagtactgcgtacctaacaatcaaaaatccagctggccccaaatggctggttcttggctactccacctgtcgccgtttcgtagcgctttgaaaattttcccttctcaagagcacatgggaaacagtacacatgaacgctcaaaagccgcagagaaatttcggaggccagtagtattcgtatcgaaatccgataggtcctctctgtggctgaaacctggaagtaaccctcgaccgttcgaacacaacacagctgtataaaaaaaaagggctcctttgctatctcctccacgctagatcgatgatcaggaacgtacaaagggttcagttcagttttcagtgagtcggcat

SEQ ID NO: 13082 - DNA, 1037 bp, Zea mays
ctggtgatcagatagacgcccgctaataatcatgaagatcgagatgcgcgcgcgggtaaaccaattaaaaaaccaacgaagcagatagttgtctacagatcactgaagaaaggcactagcctagcaaagtaaaaaaagcattccactagaaaaaaagaagcaaacccctataaagttggcatcagcgatcaagaaatcgatccgcggggagcaaaataaaaataataaagcctagttattatatacaggtttgagatctgtgcgtgatcattgaaactatatgaacctgtttagacctactctaaattctaaaaatctccaaacagatggtctgttatgtatctatatccacagctgataataggaacggagaaccgccgaaaatgttcttttgaatagcagtacactccttgtgtggttacaaaaaaatactgtgctctctacattggtgaagggatatcctaaatacgtacaaaatgtaccatcgttttttaaatactattatatcaatactgaatattaaaaaattatagcagctgcatagagatactataacaaaatgacaaaaggttgaagatttgacagctatgctctaactaaccgtgtcctcgagacgtgatacgactgctcccggctcctgcgctgctcaatcagagtgctcatttttgcgttgcctgcttccttcctccctctcgttgccatatactagcttccccggctcgtcgagcctgcggccactaaatgtcctcgaaactgaaccaccacgaactgtctatctgcatccatctcttggccacacccactgaccgcgccacaccacacctgtggctctccgcctcgagatgctttacacggtgtagctggcaagaagccaggaaccttccctgttccctcccgggcgcaaaggggctcacttttaatttcctcgagaggggactgcctcctttctccggcggcaagccttctcctgccttgttgcctgccactcgggctgtcctccttcttgattcttggcaccgtcggtttaatttcgcgaa

SEQ ID NO: 13083 - DNA, 299 bp, Zea mays
ggtgtttcttgtttatgttgtaattctgtagagatcacagacatctattatcacatagtttgttgattattcagttttcttcattgttatgtttcctcctggatgtttctaattatatgagatgcaaacatccaggtattggctatatgcagcgatcaaactaaattgtttgcttgtgactaatgatgaaatgagagatcacatattcgagcttctagggctgtctttttttcaaaagtggaagcaacgccatcgggtgagctctacaaaaccgatcatataatgctatttctctatgc

SEQ ID NO: 13084 - DNA, 881 bp, Zea mays
ggtgtttcttgtttatgttgtaattctgtagagatcacagacatctattatcacatagtttgttgattattcagttttcttcattgttatgtttcctcctggatgtttctaattatatgagatgcaaacatccaggtattggctatatgcagcgatcaaactaaattgtttgcttgtgactaatgatgaaatgagagatcacatattcgagcttctagggctgtctttttttcaaaagtggaagcaacgccatcgggtgagctctacaaaaccgatcatataatgctatttctctatgcatggttaattggttattacaaaggaagcctcgttctagaagcttagaatacttaaagtgtattttttattctaaattctacatacatatgtttttcagtcaacacaactccatctcatatgttggcaagtcaatcaactttctgagagtatgctgtgacgatagtggctaggctgatgctgctgccgaggctgctgcatatgttggcaccacaacatctcggggtggccttggttatggggagactgatgctttggaggcattggtggttgaggcagccaagaggattgatcgacatttgcggaatctgtttgaatgccttcrccaatcctgattttgtgtgtgttgagatcatgaattcatgatgtttgaagtttgaagtttgattttgattggtctgtactctgtacatctagctgcaagagaaacccgtgtgtcacctgtagtcctgttttaattgtcgtatgttttccattctgactcactttggatttcattttcctttagtgcagatttgactcttggctcaggtgtcactgtgccagcgcgatcaatattagtagttcctcttcatctcgtgcaa

SEQ ID NO: 13085 - DNA, 1018 bp, Zea mays
aatggtggctgccatctctttcatctatgccaccaggtccaacttaaggactgctttctttcatttctctttcattttttttggtatgctctatgttccttatatccacttaacaacgtgtaactggaaatgaccgtactgtgacatgatgtatcagctggtattatggaatgaatcgaaaccatttccttcatgttgatgcttgttgtgttcttgttgctgtccacttattccaacacgcatgcattacattacagaaacattcaggctagcagaacatccaggttcactattcatcatggtaggatgctagctgacgaggccttctccaacggttcacggtattactccccccactccatttggcgtgtacgacgtccaccccacaccacaagctcccacggcgctccccatggaccccatcccctcccccatggccgatgagctcgttcgtcgccccatatatggagtgaggttcggttcaccctatccggccttttgtactcctctcctcgtccccgcgtttcgtgcaaagtatcagagaagggaggcgacgacggtccgccgccgatggcccgacgaggaaaggatcgattcgctcggtgtccgggtgggtcagcatcgtcgaacccgacaacaacctaratctggcggtaggaagaacgcttggtagcggtggtggaggatgtaacatccggccaatgttagagatcgcacatacaagtactagtgagtacgtatttgaatttgtaatgatggtgggccgtaccgggccgtagtgggctatactcatgacattagtataagtatgttgtaagacttaaagaaggggcatccaaaaaataccagaaaccaaaacgaatcaaccttccggttgttattgtattccggcgatcacctaagattgctcatctgctcatgtcgatgacatcgcgccgatcaagggccgtgacaagtggtatcagagccgaggatatcctgggtggggcgcgtgcgagtcgcgtccttctcggcagcc

SEQ ID NO: 13086 - DNA, 892 bp, Zea mays
gaagccgctaagccttcaagtgctggaacacattgttcttgtactctgtactcagtaccttcaaaatactctgtttcatggaatgatattttttcatcttgctaaaacttaagaaaaacaagtaacatgcatgaatcgaatactctaaggttcagctccctccatgtgttggataccattaaatctgctctctttgtaccctacatatctggcaccatttttagggtgagtgatgatctttagtgtgcattttgttgctgtggctggcgccgttctgctgagtccaaggccgattaagttttagatcatgtgatttattttcctacatggctgattcatcagataagcttccctgtgcctcctaaattgattaccaggtcactgccctggcaatttgtccaaataattgcataacagaaaatgttgttgcatataacagataaaagatattgttttctttcatagatggttttatctatccggttgaagtggaatagtcagctagctattttaagcaggagactttcctagttctacctcagatcaaatatccatttgtgccttagttggatgctataattgtttcttttttgtcctataaagcttataactttctcatgcattttcaccctgtcagcagggttgaaaaacaaataactccacaccttttgtgttggtcctacacactgacatactgtttggatccttgtttttagaatccgtgatgatgtgttacgaatttactgcttcgagactggtttgtacactgttgtacttctctactctgtatttgttcccacagggttattataggaaatgcagtcatgctgtgcttctctagccaataagcctttgttgctcctgttcacttgcagcggagagaccaggagcc

SEQ ID NO: 13087 - DNA, 784 bp, Zea mays
ctgacaacatactagggtaatcacaatagttaacacacaagtaccaacgatacagaaaactagatttgtggccttagcatgaccattggtccattagctcgacaaaagcatcattaagtaaagtaacaattgcatataacaaaatatgacatctccaaacatagcagcaacagggggctatgctcctgcactatctttcattactgcctaaaaaatgaaaacagcgatatattcatatgtataacattcctggtccatgccgcacgcaaatacacaaaggaaacaatgcatcaagtccaaacaaagtcctttattgacctgagtaacaattggcccagaatttcagaacagcaacgtccagccattttgcattgataaacacttaaaaattacagctcagccattgcacaaatgctaagtccaatgttttcaacatcgcaatcacaacagtttgactccagcttctctgactgaatctataacggccttcactttcccatggtacttttgttctctcttcatgtggatggacactgcaggtattcccttgaggagcaggcgctcgccgagcaactttccaatctttgcagctgctgcgacgtcgcgggtcgactccatgtttggtctcaacagcttctcctgcgagcttgcagaacatgcaacagttgctgttggggtgtggacgacctgagcagatacatacttgtttgagaaatgcatcctcaacaggtagggcttgaggaaacgggtgactctagctgcccttgctggtggagggatcacc

SEQ ID NO: 13088 - DNA, 244 bp, Zea mays
gttctgcgattttggtctcaggtctgatggggcggagccacacctgatgaacatccagttccagaagaagatgcagctgcaggtgcctacttcagtagggatgctattccctctggcttgtgatgctacacgcccagcaagtttcttagtttctttgttgaattagttgaagctagaaggacagagttggtgatttgggttctgcgattttggtctcaggtctgatggggcggagccgcacctg

SEQ ID NO: 13089 - DNA, 199 bp, Zea mays
agtcagtgcagccttcaatgctggtcctactgatctgggatactcacctttgtaatgaactttctgaagtcaatagcatctcccttagtaggtatccttgctctacactatgatcgaccaacggtgcttgcaatagggactgttttggctgttagtgttagccagtattttgggcaggttgcattcaggagagcagtaa

SEQ ID NO: 13090 - DNA, 386 bp, Zea mays
gctttagagatagctgccgagcgactgaagacatcatcggcgctttagaggcaaatgccgagccattggtgataacgtcagcgtcttagaaatgacagccgagttaaaacgggccgtgtcggccacttttaaggataatagccgagtgatgatgtggcacaccgggtttttagaggtaaccgccgggtgacgacgtggcacaccggtgttttagaagtaaccgccgggtgctgactgggcgcttttggagacggtatccggctcgggaatatcccgcctatacagcgctttcagccgcctctgctttccgtgccctagttcttgcttttctgcccccaaatcctctctgcaattcagctctcgctctgttcgccagtagattcgag

SEQ ID NO: 13091 - DNA, 254 bp, Zea mays
tgagcctgtgtgtgtgcgcgcatgtacgacgacgacgactgcgggtgatgctgttcaaggagcggcaagtgcgtgcaactgaggttgatgtgttgtgttgtgtgatgcagcaatgagttgcatgcaaaagttgatgtattactagctgctgttgctactactacttgttacataataaggatacgtgttttcagaaatcgtactcctgttctaaaatataaaatgtctaagtttatgctgaatcaaacaattct

SEQ ID NO: 13092 - DNA, 1191 bp, Zea mays
gcatatggtttttacaacttggagaaggctaatgataaaatactatgtaatgttatgtggtgggctttggacaaacacaaagttctaacaaagtagttgtgttcatcaaggacatgtacaataatgttgggactagtgttcgaacaagttaggggacataaatgactacgtacatcatgagttagttttgagcttttttgccttggtgatggatgaggtcataagggacataagagtggatatccctcggtgtatgctttttacggatgatgtagtactagttgaagaaagatatggaagaataaatagaaaactagagttatgacaagacactctaaagtctaaaaggtttaagactaaaaaagggcatactctgtgcgggcaactcctagaggagtaggctatatgaggatggaataaccgaggtaagtcttacccatgtcgaatcgaggacctttggctcaatgagaaagcttctcaccactgtgtctgcctgttttttatgtgtgttgatgcctatcgcatatattctttgattatgtgatttgctagtcgttgtgttgctagctctgtgtccttgacctgactggcttgataacgcaggaggccttgtgcagaaaacaaggaccagctcagctagcctgtggtgtatatctatggccggctgagcacatccctccaaaggttgaggtggacctgagacagatctcgatgtcggagatatatagggtattaatgcatgacattcccgtccatccgtcgtcgctcaagctgctgagtaaaaacgagaccatgcctgcccgtctgcaagatcttggcctcaaagccagacgagtaggaggcgctgcaaatacttcagagctgataacattgtacctttaggtggtacagccctccagcagctccgtccctagttcttggcttgctttttggtcatctgtcccctaggtttcaatgtgatagtggattcagacaagctatgggcttcaagtaaagatacgaaggaacaaaatgaagaaatatcactggagagacattgtctgtaccaaccgctatagaataacatcctttctcattcagtttgggttcagggacacatgacatgtaagacgactatcctttgctgtggcctgggtgaattcattctctaagctactcttgcagcggctcacaattcatcgtcctgactgc

SEQ ID NO: 13093 - DNA, 70 bp, Zea mays
tgtgctataatacctacttggttaaaatacttggtcttggtcatacccctcgttcccctgggtgtattgc

SEQ ID NO: 13094 - DNA, 148 bp, Zea mays
tgtgccgaccattttcatgaactatgataatcagactatgataattaagataaatagttctaaggataatatgaagtcgacaaggcacataaagagcgtttgaaatccatcaggaaattaagaaactccagagtaatagcgttggatt

SEQ ID NO: 13095 - DNA, 157 bp, Zea mays
taatgcatgtaggtccccaccactttgacaatgcaggcgcacacctatatatttagagcagctcgcataccatcttggagcgcagcggaccctctccgtctccgcacacccagtcaatcacccagtcagtctcagtcaatactcgacgccggctgac

SEQ ID NO: 13096 - DNA, 1022 bp, Zea mays
ctttccagcagagcagagcaggagcaggagcaggagcattatccagcctatagccatgtgtttagcagctcaacatccaccacaccatcgctcatgggatgctctgctctccgccgccatcctgtcctgtcctgtcctctgctctgctctccgtctcctccagtccacccaccatggcaggcggcagcagttggcaccaccgtgtccatgtgatgaaaatctacagctactaccagtactaggacagtgataatgatctagcattcataatagtactaggacaggaggtcaacgatgctgacagcacgtcgtctcctgaatctgcaccatgtaaacgagtagttaaaagaagtaaaacttgattcgtgaaacaagaaaactacagctatctttcactaccctcggatttgggtgtactgctgtaaaagtctcggttactagcagcggtcagtaggctgccgtggtcagtcccagcagccagcacggcggccgggcaagggcagcatggcggctggccggagcgagcgcgagtgagtttgagcaggcaacgatttacgagacaatctaaattaaaacgtcccaattacggcattctatttttttcgaccaaaagcattcaatttaggtttgtaccaaaaatgtttacaattgttatcgaaatgcacggcatttcccgatctttcgacgagaggcgtgtttatgtaaatttagatctaaaaatagaatatttagtaggatctatttagaatacaaataataatactctcttctatatcttaggtaagatagaacaggttaaactttaaaatagagggtgtatacaaaatgatactcctacaagattattttgaaatttcgacgagatttgtcggaacaatgcgactccacttcagcagtgcgcagcaagccgccgccgccatttcgaaactcccgatcgccgaccgttgctttctttcccctcagcctcgccacttcagagagagagagagagagwgwagagagagagagagagagagctaacg

SEQ ID NO: 13097 - DNA, 58 bp, Zea mays
tttgttcgcagattatgcaaggtcttcttgatcagtacacaggtttgctgggaattcc

SEQ ID NO: 13098 - DNA, 1500 bp, Zea mays
tccttcccctacctccgatctcttcttcccttcccaacctccgcttccttccccttgatttgagaggaaataaataaaggtgctgcagccttgcaacagggatcgatgtgtgtctccacgggatgagacaaaagcgaatctgcacacacaccagcagcacgctgtggccgacttctctagcttcccatgcatgcatgcactccgcgactagcgttcgagtaatctcatgcatcgtgtacttatggttttgtatttctacgaggaggctgtgttggtatatattgttcaaattcgtgaagccgtggataattggttattaggaaaactagcatgcacacacagaaactccgtaattgatttaagcttagcgtgcatgattggtatatatataattgcactggaagttggcacaggacaaacattatggtcagttgatcgctctgagtttatgttgtgaacccatctcagttgatcagtccgagacttctttgcttctaaacagaagagacaacgaacgaatacgaagcttatctgcgctgctggtggcgtgttgttattgcaggacgcatgaatgcatgcatgtcggtcgcaatgcatgaatgcatacactgatacccatatataataacaaaacttgacgtctccgtgaccaacaactcatgttaattagcaacatagacgacaagcaggacaggtctgagtatgaaagaaacctccctgagcttgattgacctccttgtctcgagccccccggttctggcaggcacacacacacacacgcaccagacggatctaatcaggaaccaataatactccttcaagctaaacatgcctcaaaccacatgctgccaagtgcatgccgagcgttacaacgattctgcaagcccccctttggaggttgtcacggcgagcacgaaagaaccctgaggcatggggtggggtgggtgtcacggcgaggcctttgcccatcccatcaggccggtaaacggtagtgcagacgacagacaacattgatccgttcactcaaccgatggagctgcttgccttgccttgcctgcctgggtgatggtgggtcctctcttcagtttgtcagattcaggagagcccatagaaagagatactatagaaagaaacaaaaacattcaaaaaaggcattcagcaaatcgccaaacttggggggttcgttgcccgtgcccctaggggctaataattgtacactcctaacgctcacatgtgacgtaatgatccacaaaactcaagctcgttatgcaaatacctccccggttttgccatggtgttgcaaatggtatggtactaatccggaattcctgatcatatcgtttaagtaaccacacgttttcaccaagtagcccctctttgcaacttttcataaataataaagggccagggccggcttgtaaatgtgtccgaagccagacaccatcgtgcaattgggccagtttgtaactagtacccttgtttatttatttatttataaat

SEQ ID NO: 13099 - DNA, 425 bp, Zea mays
cctgttagaggatttctatttatcaaaatctctattcctagcaattagaaaagatatagaaaatcatttatagttgttgttaatatagatatacattaagataaaaaatagagataccgatatagatattatatatcaatatatttagagagatattagcagaacaaagtagatatataggtagggttaattaaagatacattcggttcctgataaaattcaattgaataattcaaatgtggccgcgtatgtgaactccgtcataaacgagaacccagccgctgagtagacttgtgttttcgcttccccttccccatcccctctcctcccctcgccggcttgtcggtctcgccgcgccactggccatacatccaagacgctaatccgtgtgggggaaaagcccccctctctctgaaactattcaa

SEQ ID NO: 13100 - DNA, 1500 bp, Zea mays
tattgtactttactgtcttggtgtattgttccttttatattgaatttgtggaatgtatgtttgaactcgtatagataacgatcagttggcggagtccgaaggagttgcaggtgaagaccctgagcagcagctggttggtgaaggtaagtgttctctgacctatttatgttctactcactttataattcatgagataaggtaaataaccttttagtcgaagagtgcaaaaatatttatatactyygcatctagggtaaggattataaaaacaatcaactaaataaagataatgagataagaggtgcaacaactattgcarggagtttttgaatctcaatagctcttgttcrgttatttctatatcatatgtattggatgagaatgaacaatattagtagagattttaacatgctatgaatttgaaacccgccaatcccatctaatccacatggattgagataatctattcgttttcaccaaaattcatggactgaagtggattgggtgagtttaaatccataacaagttaaaatatatattattatttttcaatctcatctaatgtatgtcgcataggaatcactgaacaagttctaaataaatacggcaattccattattcggtgtcaggatttggttttggaccgcaatctcatctatattattgtttttcaacaatacgtcaatctcatctatattattgtttatcaatctaatctgatccatgtgcatgacggtaacaggttagggggtgtttgggaacaaagtttttctgcagtattgaagcaatactgtagtattgagcaatactataatattatatactttgaggtgtttggcaacccatatgaaatctctgtatactaaactgtattattgtaaatactacacttgttttgtagttttagaaactttggtctcagccaaagtttttctatgtaaagagagcgtcagctgggtcccgctctggctgattggtctcaaccaaagtttttcccaaacaccttgatatattggatactattgtattcgaaaactgaagcattgtaaactgcagtaatgttatgactaaagtatactttagtatttaaaaaactgcagtttggaaaaactgtgttcccaaacagggccttatagataaaaacgataatgccagggatgctgcaaggaataacagatcgtaaatatagtgattgtccgttccaattccgtctcgcgtcctttgcgtcatcttgtttgcctcggatttcgttttgggccgtaattgggcctcggattttgtttgcctcggatttcgttttgtacctgactataaataaacacgataatgcgccaaggaggctgcaaggagccaacgaatatcagaatcgtaacaaccacgtatcgcgcttacctgcgtcggcgagagctcacgtcgcggcgattccctcggccaggggcgagcgtgacagcatcatcttcattgccgccgccaggggttgatcctccctgcccgccatcc

SEQ ID NO: 13101 - DNA, 130 bp, Zea mays
ggtcagtcctgcatcaattttaaaacataattagtaccttttttttcattttcagggttctgatctcccatgccacagtttataacgttgaaggattcaaaaatctacagaactagatgatacttgcata

SEQ ID NO: 13102 - DNA, 1052 bp, Zea mays
acgcgtcgaacatcgtctccccactcgacatcagtcgttgctgtaatggttggtgaagcgaagatgaaaacccaggacatatatcagcatcatgtcatgtgtaacaaagacgacaactctcatgtgttgttggtgttgtctgctgctgttgtacgacatccgccgctcgcttgtacgaccgtactgcacgtctgcacttcatctgccgggcggccggccgggcgagcacagccgttctttaataacatgacgggcgcatgcacacgccagctgactcttcatgtcgattgcgtccagacaattttgttaggactggtttgttattaggagcagacctgccgtttccatgtgcttgcttcacggagcacggcagctctgtaaacggcagactcgacgtagcttgcacgcacaggggttttcagctaaaaaatcctctagcgacagttcattggttgcccagttcaccgactgcctttataaacagggagctcgagctcgagtggtagcagcacaggcacaagtgcggtgccataagtgacagccacctcagtctctgtctgtggagctctctctcgcgcgcgttgccatctcgcaggttcttcatctcgtcgctctgttcaggttcatcggctggcgttagcgtttgttctctctcatacgactatttcatgcgtcctctgctgcatctcttcgattcatccgtagtatcttctttttacagctagtttgggaacccattttcttaacaattctattttttttcaaaaaaatgaactaattttctttaataaaataaaaggtttctaaactagtccttaagtaaaaaaaaggggcggtcccgagcaaagtcaaacggtcccgagcaagcaagaaaccgtgtcgtcgattctcttttctctctggctttccgtggcagcaagaagaagggatcaaaggaccggaccccgtccgtccgtccggccggcctcctgatcgcgtcgcgcgcgcccctcgaaaagccacaccccgccgtctgacctcgtggtgaccggtcccgcaggcggcgacaggag

SEQ ID NO: 13103 - DNA, 666 bp, Zea mays
cctgttgggggtatgcttcgtagccgaagatcctaaagaaagagaacaccttcggaagatcctctcaggagcaagcgccgaagctattacctatagagcttcggcataatgacagatctcaagacgatgggtcgaaccgacttaaagatggattgacttaaagacccatgatgttttgtgtcattattgtagtcgattgtaaaggacataaatgtaattttacacaggctgcaccctgtgcttataaataggtgaacagtaccccggcactgttcacgcaatcctgtaatcgctaacgcattacgctggaattattttctgtcagaggcggaggtataaacgtacctaaatattatgtttcgacatttaagctcatattatgaaatatatgactaatgtaatttgtttttcctataatgcttagtattttatattttatttcgtattgatgaatgtttaaccatgaaggtatgaccttcggggtattttgtctatgggcttcgttcgaagttcattaaatccatggggatataatgcttcggcgaacgaagggcattgtcatttaacattttctgtgttgccttgttcttaattcatatcatttgagaacaagtccccaacattggcgcccacctccggtgaactcacttccacctgtttgagctg

SEQ ID NO: 13104 - DNA, 694 bp, Zea mays
tggtggaaggactaattcatataattgtgtaatgttactccatatgtttaatttaatatgtcctcagactaatatgaaatcatttagacaggaaaaaattacttcttactctggtttttaatttaataaagccattgatatgacttgtatttgttttattgaaaacctttatgtaaagatacaaaattgtacgcggtgcttaataatttttaaataaagtaagccacaacaaaatagataatttatctaagaagttaacaatagttttaaaatggatttagtatttactctgtcgaaagcaatggctggttataattttgtcgatctcatcaagtgttggtctagtgttcagaaaggataagtatatacctgtcatggttgtctatatatgtgtccgggtacacgtatcaacatccagaagcagcttaaatttcttttacgaagtccggtgaaagaactagaaacagaagtggaaaattgagctggcccacattttggttatcgtgtcagttgtgtcgtcaaagtgcaccttggcaaccaaaagcgctctctcttactatcatattcttatatataaaatatgtatatgtatccctccctgagcaacgtcgatatgtgaagaaccattctatactaaagcaacgcattatcgcgataccgatcgaggagaagagaacgtaaggtaggcgacgtc

SEQ ID NO: 13105 - DNA, 1304 bp, Zea mays
agcagataagtactcagataagatagctagagttgtttagattttccttaaataaaggtagtttgtttagatccccttaaaaggaggaagtcttgttaggccagggcaatatataagccctctatgcctttagtttgtaatcaggaaagattaatcaaagaaagagattgagtcttgcctccctgttgttctcaactccattgctgcgcctgaaccctaggtcaggcgtcaccacggcaatctctcacacctcttcctccaaccctccaaccattagccactcatacaacctccgtagccggggtaattctaacagtagcagtgttcttaaggcgtcgcctaggcatccagtccctcggagaaatcttgccgccttgcctgcctaggcgttaaggcggttgttctgttcacttgctcgcctaggcgccttaagaacactgcatagtagactaggaactttcttatttgccacaagtcactgtttatcatacccagagtattttctaaattggtatataactgaaactgcttttgcttctagtaacactgagtggaacatgctgcatctgctggctagctgttttcctgccctcttcgcctgcaaatagttgttctctgacctagataatattttcctgttcatacaaattggtatcgtacccatggtagactagtaactttcctattttccacaagtcactgattatcatatccagtgtgtttggggcttgcaaatggtcttgaattcgtttttcttaaaccacgcaagtacgcaaccagtatcttacagagtatttacgaacactttttgggcctgcagcattgtcccagacaatccttcagcacgaatgatggatcttccaaccacaaggaagctcgcgatgaaaaataaaattgtttttggcacaggtgaccattggcgggcccctactttgactgctaacatgggttttgtaagagctgtttcccagtctagtatgtccttgctaaccatcgagcaccgacctcgggcgctgattggtctgtgacagttagtatgccataactattctataggtgttttgagatcctaacgtttgtaattctgccccttctgaacattaaacaatatgaagttctggtaattgtagttgtcctactcctagaactatggtgtagtgtaggatgtcctagtttactccagtgtctagtactgcgagctttgtccatgactgtgtaactggtccagatccactggagtttattcgagcgagaatgcttactatctgtacttgtatccttgacgtcaaagtcaagcaaagcat

SEQ ID NO: 13106 - DNA, 694 bp, Zea mays
ctttgtctcaccggcgccacagacgagcaagagagaactcatcctccggcacctggtccgccgcgagccgtacccacccgctaaggccagggcgccccgacttgagctaaccgcgccgaacacgaaccgctgctgttcctcgggcagctcatcgcatgcctaggtacctgcggtcagttaatgcaaaagcaagcccctgttcagctcgtttttggccggccggccggtcgctgagaggttgctttagcctgttgagcatcctgaataaagaatccgccgaggaggtggacaaaaaggaaggagaggctgagccgtgcaaattccgattctttgggttagaggtcccgagcggctcaggagccaggctattgaatcaaagtggagagaaacacatgggccatggagaagctcttgaccagctagtaatcggcccagcagctcatgggactgggagggagctatttttcatgtcaagggcgtatctgtaactctggaagcttgaaatttcggcccttgtgcactcaggaggcctgtttgattgagagagagaaaaaaaaccacaagtagcagcaagaagctgaagcatatcacggttgtgactaccccacactgtcactgactgactctgcatctaacctgtacgcgcacgcacgtgtttcgtggttctggggattcaggggcagggtcgtcgagg

SEQ ID NO: 13107 - DNA, 136 bp, Zea mays
ggtattatgtccctacaaatagtattgatggccgctataatttggttatctagccctaaaaatgccccatcagtttcttgttgtaatgtgggctatgggcatctgatggtgatacaatttgcctttactgtataat

SEQ ID NO: 13108 - DNA, 387 bp, Zea mays
gctgcacactatggtggcagagcaccaattccagtccactgaatgttactgcctcgatataagaatgacatggagagggcctcaaaattccacaaaattgttccgagagtgcgaagccaatggacacctaatacaatgtcaaatccatccagtggtagggtatagaaggatatcgagaaatcagcttctccaataaccagaggcagttgagtgcacacacccgcagtagttacccgatctccgttggccaccttcaccgtcagacctggacgaggttcaacttgaagctgcagctggctgaccacagaatcattgatgaaggaatgtgtcgaaccagtgtccacgagggccactaactgacggccatacaaacaaacagaaagtttc

SEQ ID NO: 13109 - DNA, 1257 bp, Zea mays
tttttgtttggccccttagagcatatgtagtagttgaggtaaaaaactccctatatataaatttaagaagtttttaagaaaaacatattctccaacaattatgtaatgcaactccctaaatttacaaagtcactatataacctgattttatcactacatttagcaatctcgatgggactcacaaatcaacgttgacgccaaatctatcgcgaagagcctactctcgccactgtttcgcgtcgtcgcatcatctccgcgatcacaaatccatctccaccgcttcagataccttgacgccgccaccaccagacagtattttgtgttgaggcgccactagagtactcctatgttgcctccacgtcatcgccgcgatcgtctgttgttccttcaatagctccgacctcctaagacgttattggtaatgtttttatggaagtcgatgggagaattcacctcgtcaagatctgtagcagatcctatgccgctaaaaaagttaaggaaggttgttaatacgtatttatgcttctagtccaattaaaaatagaaaggatatctacttattttttcgttgacgtggacaacttaaaaaaatagcgaccaataaatggagaactcttggaccacaactttttttaaatctttaaagtattttagtagctttttaaatctataatttagggagctaaatttacataactattgtagatgcttttaatatgtgtgcttaattaaatagggtgtgtatatgtttgggacggttgtaaattacctgtgagatatggcatatgggtagtctatatccttacccacacccatctactcgacgaatatacgattaattgctttcattaacataaacacgtaaagaagttatcttataccatcgttatatccggtaaaacttatcaaatactcaggtttcgagtataatttgtcatatctagagacaggcttatcgctactgctactgagccttccgctacgcagctcaaggtaaaaacagctatcagcgggccacagaagctgctgccggacgcggcaacggccgtcgtccctgtacagttatatatacagaatatacagcgaattctgccgctctgccctactcagtaggcagttgtcgccgcgcataatcatactagtgacacaatcacagctagccacctccccgtccccagcatcgccaaaggtcacatcggtcggccacgggcgcggggcaagaaggaccaggtgacggacgagcaggagggaggaata

SEQ ID NO: 13110 - DNA, 181 bp, Zea mays
acaagaaggggagtggatctatactctgcatgcttactattaccatagaatctagactcaattttgggcatagcatttttgcctttgcaaatgcattcatccatctgaattttgaggttacaaagtttagacactgatcgaactgctattgtgggttcgatctaatctattgtattgctat

SEQ ID NO: 13111 - DNA, 286 bp, Zea mays
gtagcactggcagcggcggcggtggcggccttggcggagagtgactgatggcacaacaaccccctttaggctcaccctcccatttgacactggctcgttgtacattcgagtgtacagttggttctgttcgccataggttccttgagctgaacaataaacaaacaccctttgctgctgttgctgctgctttcgcagtgagtggtctcgtttagttgtaacagaagattgtacaggccatgtgagatcaccaccccccggctttggcttaacagtttaacttgagcca

SEQ ID NO: 13112 - DNA, 150 bp, Zea mays
gcggccggagttcctcatttgatttcgctcagaaaagtagaaaacgccagccgaacacaccggtccgccgcccacgccagcgctgagctcaccaggaaaccgtcttcttccactggcgcgggctaggagcgtcgccgccgcgtcgcggtt

SEQ ID NO: 13113 - DNA, 183 bp, Zea mays
ggtgagggattcatttttttttcgttcgattcatttttcaccggatactcgactggctagcctagtacagagacgttggttctcttctctgtcactgacgatggttgaacgtcggatcgtttttttgagaagaacctatttggagctggaacagagacgacctcgaccaccgtcgaatgggcc

SEQ ID NO: 13114 - DNA, 130 bp, Zea mays
ccttctacatttgtaatttaagcaacatctagttttgtcatataatttgatcattaaatgattcaggacaaaggctggaatgacatctgctgctgaaagtatcactgagagcctccgacggtctcgctag

SEQ ID NO: 13115 - DNA, 1500 bp, Zea mays
cagtccagtacgtggatgaatcgcagtcagctggggatatattattgtccaatcgatatgtccaagttgatactaaatcacctggataatattgttctcctacgtctaagtctaaccaatctactagatacccgtcgttcaaagaaagttgcatctcttggaggccagggatatatcatagacacctacaacactgcacgtcacgagcacgcagcctaagcgtcgcagtttctgggcagcgacgtcgacgtgggagcggtctgcacagggctctacctcgacaacgtggcgacgtggacgtggatcatccatgcatcacggtggatgtgaagcgaggtagccgagtagggggccggccgccagggctcatcacggcacgggaaaacgctatccacaacacctcgccaacctgtgggcgacaaaaccggcgggaactaaccttaccttggctcttccatgcatgaccatccgatcgacggccaaaaaggaaaaagcgtggagacaagaatactgtacgccttgtgaattgtgattcagcaactgagcagggatggctggtgatttggctcttagcttggtttttcaacgtcgacgtggtggcctggcgcttggatttgactttggtgcgtgtctggtggtctcatttggctcttagctcgttgccggtgaatgcgggatgagatggctgaaagacacgccgacccatgcgttctttagtttagctcatcttttcttcgaaatctcacttcttcagctttaactgattagctaacctcggttcattttggactgtttttaattagcaggcataactttaactacaaggtaactctggcggatgaaacgagcctcctcaaactctaagttatttgtttgtttgtaaaaaaaaaactaaagatacgttattcatatttatctatatactgtatgttcgtagaaacgtttgtttatacatattttccgtacttgtattgtagtagaaaacgatagatgaaaacatattttccgtacttgtattgtaatagaaaacgagagactttatagtagtagagtagactagtagtattttttttcccaattttgttttaggactagtctggtactggtagcatattggtatttgcctatttggtacccagacccacgcggcggcacccgccaccgatcgagccgctccggcgagcgcagcgcagcccacggcatttgccgatttgtgaaggagcgtgaaaaagcccttcccacgctgggccccgcctccgcgacgcgagcccacacgtccgtttccggtgccttggccagacaggcagcccatgtgctgagctcacatgcctgccgctcccacacctcgccaccctcctgcctcctccgcatccgcgccccctcgcttagcctaaaccgcggggcagctagtctcgccaccgcaggccgcaccggtcatcacaccggagcgcacgcggggagcccccgtagagttccggggcgaccaggccaactaacgcc

SEQ ID NO: 13116 - DNA, 238 bp, Zea mays
cacgtcgctactgaacactgtgatatttcctttggccgtgctcgtactaatcggagtcggactactcctcgagatgatgaccgaggcgttgcagttcatttgtctagatacttgctgaaagctatttcttcttgcgctatgatggaccatactagctattttgtgattctagcgcccttacaaaatatttatcactgctttgcaggttttgccgctcgagtttagataagttccttca

SEQ ID NO: 13117 - DNA, 890 bp, Zea mays
ttctgccataacctgttgtatctctatattcaagtcggctacatgtattgcgttagtgtcttctttctcgacctgccatctccaaagcccaaactcataatgagttccactcagaaatttggggcatggttattgaatcaaaatgaaaagttagcacacacctatacagtggatgatgaggaggacgatactcttaacacgcgctaagagggagcaacacccttacgtcggtgctacaacgaggatcagtgggggaatgtcggctctctaaaacctcggtaaaacattgagtagtcttctaatccttaccttagtactacatatatttactcttgagcaattcaagttaagtgtttgcattcttaaaattattatgctagtgtatagtattggaaattagggtacaaaacttcgtatcacatcattatctagttaggtgaagttatactactgattaggatttaaattgcacaatatttttttgaaaagcctaaggcacaagaaagttaaccatgcgcggcagtcgccgaacctcagcacggccgttgctgcacacggctttacggcctcagatggcgaggagagctgctcgctcggactaataaaggcccatacaggtccggctatatttagcccacaaaggcctatacaggcctggctcgacgagccggcagcccggcacttataattccgccttctcccacctgtctcacaccctctagccaaaaccctagcagccgcccggtgctccctctctgcaggtggcggcgcgctcccctcgcctcgtttgttcttcctcccgtctccctcactaatcgctactgacttttctcttgcctgatccagatctcccttcgcagccgccgaggaaccccttcacagcgcggaag

SEQ ID NO: 13118 - DNA, 371 bp, Zea mays
ggtgtccgtgaatcacgatgcgctgaaggatggactaattaagcatcgaacatcgtgaaggacagatatttcttagcgcattgcccacaacaagcaagcattcttggagaacctaccgactgcaaggtgatggaatcagtctggactgtgccatcacaagaccctgtgaacttgaaacttctctttcatactgcaaaggcaatctgctggacaccagatggagcgtgttctttttcctagtttgttttttgtttgtgtaatgttgttaatttgtttgccagtttctacttcaaagctgtgatttgaggaactttgtgaacaaagggcctgattcaccttgacaactgacaaatgctttctacaagtgcagt

SEQ ID NO: 13119 - DNA, 635 bp, Zea mays
tggcctatgatatataaactgtagcaaagcatagaccttcgagtatatgtatataagagtataaagcccgtttgattagagggactaatctttagtctctagtttttagtctcacttagtccatattttgccaaacggaatgactaagtagagaaaattggctttaatttctagtccctcgcatggatgctaaaagagagtaaaggacaacgtttacttcaattatctttacctagaaaactgacgtgaaacaagaaaaaagatattttagtctttatgtgttgtatttaatatatttaggatttatttaattcctactaccaaaaaaatagtgactaaactttagttctaaatgrgaccaaacggggctaagacaggttggtgttggtgttggtgttggtgttggtgtgacgtttttctgcctagctcttctagaagacccgaagtttaccaaaactaggaagctaattattcgctgcggaaagaagtagagctcacacatctgaaacttgaaaaccacgctcgcggcccggcccggtacatacattaacaaagctgcagcttcgaggcctcagctcccgactcccgagccggcagcgattcatagcatcagctattcatccgcgcgtggtgca

SEQ ID NO: 13120 - DNA, 543 bp, Zea mays
aataatttatacatattttgtgatttataaaattaagtttacttatatactatatagaagccctaccaatacacgatgtatgggcaacagactaggagaggtaaaaacgaacgaagttgcatctgggtagacggtagaggtaaccacacaattgccccaaaagtaaatgtcataataggagaaaacaactgtcttgcatcaccacgagcgtgggctctctctctcctttctcgacgacgactgggccaccgtcgctgccgcctgccgccctacgccaggtgccaagcagccaggtgttcttggggcccttcgccggcgacgagcaccaccaggtacgtccgccccttggtcttcccttcccgcttagcgaaaccaagcactcaaattctaactattcgtggtcggatctgatctaattacaagtgcatatgcatgtattatgcctactgacttcaataattttgcaaaaatttcgggtttacatgcttacctatgtcgtttactggatccgcccctggaccctggttctatggcagctgaaat

SEQ ID NO: 13121 - DNA, 117 bp, Zea mays
ggtattattattaatgaaaattttgaatatctctattgctagatgccgatgtatatatagagaagtatatgtgagatattatcagtaaactttgtttctattatctaggctcgtggt

SEQ ID NO: 13122 - DNA, 343 bp, Zea mays
acagacaacgccgctcgtctctgtaatgtctctgtaatactgctgcataccaaaccaaccaaatcgatagcgcacactaccgagtactgactaggcaaggaaaagtaatcttgcataaaggctcccctagaatccaacactgcgacaggcagggtagcactgtaaagatcctagaagcagcggtttttccaacttgctagatctgattctgtataaatagttgattctttcgtcattgcattcatagtgctgtagatgtgcacctttgctgtgaatttataatcctttgtcggctggtgtatctaacgcttcggtttaggatgtgctgacattcagtgagctt

SEQ ID NO: 13123 - DNA, 649 bp, Zea mays
tgcatgcctgcagtagaggcaagcatttttttttggcaatgttcactgtaaattttgagtagtcttgtttcttctaagtgctaccttggtgtactttagcccatgtctagttctatcgtgcttaggggtggtaatagatcgcgatccaaatgtttcttcacaaattgttagagccctatattaattttagttaaaatttgaataaaaatagagcccaattctaatcctatccgatccttaaaatttatagtgtaaattttagagcccattgtcacccttaattgtgcttaataccaaaggtaggtgtgctgggaaaaatactactcgcagattcatgatgtatcatttgctctagtcaaacaaagttctacacatgcaaatccttttctatgaagcttgttgtactcaataatggcattgatagacagcaatgcctagaaactgtctgttgataacttgcccgtaagagcttcctgccttttcaaccacagttctggtggtgctttacatagacatgaagggctctgcatgatactagtttattacaatgaaattgtttgataatgggttacaatattgttgtttatgctattatgcttatccaaattctgctcacatgacgtattctgtcattttgaattaaccagca

SEQ ID NO: 13124 - DNA, 1500 bp, Zea mays
agtctcgtagcttttgtatttgaaaatctgatcgagtttccaatttgtatatgctcttagactgtctctagcaactatcctattacatttcttatctcatcttctattttaaaccatattatataaataatgtaatctgcagtataaatcctctattttacacaatctattatggacattgttactactgcttgcctctttcgtataaagggcgtgtttggtgtgtggcgtgtggcgccactccacacctaagttgcggcggccgaatcggcctccacaactgtgacgtgaaaagtgtggtcggtggcagcggcttaggccaactaccaaacacgcccaaaggcttctacttctagttatcaggactaaacacaacacacatatttagacgtcggatattatgatacccaacaaactaaacaaatataagagctcacctatttttactatgagtacatctctagtagcttattcatccttatctttatattcaaactatactctatgaaaatacagtctacagtgcaaaataatgttttaggtgaccatataaatatatggctgaaacggttcttatagcatgagtcctgatcatccgacaccaaaaaaatcatatattttttataactttttaattatttaacaaaaataaacatgaataaatctactccagtcatatgttatatgattaacataaaaattgtactatatatcaagcataaatgattagatcattataaaaattatcacaattgaaccacacaaaatatagctatgaattaatcatagaaatatatatatttagaagctatagcaaaaactttatacttaaatataacctatcatatgtttagtgtgtatacaccatgtagaatctaataaatttagatttttattttatcattttctatggtatattataaatttttaaaagatttagtcaaaataaatataaatataaaaacacttagaaaaaccatatgttcggttttaggagatgatagagaagttgagcgagattttttcccaaatatagttgatcgggtgtaaaatagattttctttctttattcttagttcttaaagtatctccaaaagactatttttggctctatatttgaccatatatttaatttttataaagattacattttatatatagcatcttactccaacagactatcgatttaatttagatattcaggtgactagccaaatttgattaataagaaagctaatttagagattcaaatagtttgacgagttagatagttaatctgttagaaagttgttttaatatttagtagtcaaaatttagcttaattgattatttagctagttttttgaagatgctattagtacttgtgatttgcaaaggtgccgcgtggacccgacctgccattttatagcaacttcagtgagtaagctttcgctaaaaccctagctccaaaaaacgaactagaaacgaccgcgaagccacaggtcgaaggcggcggcggcg

SEQ ID NO: 13125 - DNA, 1500 bp, Zea mays
gagacctgaacctccttcgtcaagctctgaaacaaacctgcctgatcgtgatcgatcgcatggctaacctggtaacccctccccgcacggtgtccgaggagagccccaaccggcaaccgggcagacctccctgcggccggctggtctagactagcagacggcgagagaaagaccaacggcatcgagcacgccgcgcggcatggggagccacgagccagcaccagcagccgccggggaggaggggaggggctcatgcaactgcaggttcggtcggcgacgcggatcaggccgactggccgatcgagacctcacgcggacgtgccgaccaatccggccgctagccttgccgcgccacccatgcatgtcaccggacggacaccggcccgcaataattcacgtcccgcacaaatccaccccgctcccaaatccaaacgttttccctccctggccctcgcccagctgccctacccaccgccgccccccacacgctcgagaagagaaaagccctccctcccctcctctcactttcacaggccctcgcctatgtcctcctctatcctcctcttcgtctatctcttcctcctcctctttcctgttccattacgcagtgcagtctatactacactactacagtgctgctgcaactgctactccgactactagtaactagtggtagcagtagcaccacggacacggagtagtttatatgttgtggagagctagccctcgctgctcgtagtcgtagctccgggcctccggctgctgccgccgccgccgccgccacagggagagctagctaggaggtatataggtatagccgtatagctagctagctgctgctgcgtgaacggggaagaggggagggggggctgctgttgcagtgttgcctgttggcctgttgcaggctcagctcgcaagtcgcgtctgcagcagctgctgcctcagggaggggctcattactccctcgttgcgtgctgcagttattgcttgctaccgctagctactgtgtacgttttggccttgccaataagctctaatggagaggatgcagctgcaactgcaagggtccatcgcctcttcgctggtaagttcacatacactacacagccaggggagggggcagccgggcaggcaatggagcacgcacgcagcttccatttgtagcggcaggcagcttctttctggaggaagctccgtcgtaaatgcaatggagtattaattctcctgctcctgctgcatgccgctgctgcctcctctagtcttgacgcttcctttcccttccatgccctctctgcattgttcacctttgctagtacttccctctcatgtcgtcgcagtggcagctctgccgccggcacccacgcacgcacgcacgcacaattcaatgcgcaccactgtactcgctctctgtgcttcctgctaggagatcgacatcgactcgactactaggagtatctttaatgtcgttgctgctgctcccctttctcgatcggcttgctg

SEQ ID NO: 13126 - DNA, 1169 bp, Zea mays
atttctcactctctttgtggtagacccaaatagaaacttaaacgtgtccacttcgctcttagaatctagaattgtattgttccgctctcaaaatctggaatggaaccactccgcttcggtggctcaccaaccctataaggacatgtttatttcggctttctaagaggttttggattttaaatttttggagtttccaaaagttaaacaactcatattggcctaaaacgcagaagctcactatagtttgcttttggcatgagagagagagagatttttcttttgaaagatctaaaaactagttatctaaaaagtggccaaaagctcaaacaagtatagccttagtagcctcgtgttgattcaatggtttaatagaacagctccaaaactaatatgttttcaaatacttgaaaattgcatgttatttgtttttcaaatttggagttataggcagactccgattaaaataactgcgagactaccacaaaacttcaagatggtgcatgcatgcgtgcagcaaataggcaggcctacatgatgacccacatactaagatcagcccaaaagataggtcgaatatcacggccaatgatcagtgttgagaaatgatctcatcctttcaaggcatcccttgggttgtaaagacacctcttgagttggcctctttaaggcactactttgtatctatataaacaaagcatccatcaattaagagaacatatttcactcttatatcatttgtctcgccctctctgcgtactcaaacacgttatcaacatgagggctctctatcgagcggtttcttcctcggcgcataacgcacacccgttgtctggtccacggggaccatctactatgtcgccatggtcatctcggccatcgtcgaggactggcgtcgtgccatcgcgctcagccagacgacgctttgcaccaccatcaccgacttgcgatctcggccatgtccagcatgtggatggtaccgtagccatgctcctgaggctgtcggaggccttcaacctcatcagccagatcgagttctactacaagtagatcccagagcacatgcgcaacgtggtggatggaaggggagttttgttttgttttccttatctccatctcctatactccccttgatttaatctggatttcgaaatcacattgtctgattcatt

SEQ ID NO: 13127 - DNA, 73 bp, Zea mays
ggtgctgggctcggacggcgtggccggatagtccgcgtccgtgcgcacctacgccaacccgttctgggtggag

SEQ ID NO: 13128 - DNA, 1500 bp, Zea mays
atgatccgtatcagctccggtaaatttagcggaggcctccggacggtttctccatcgcccgctatcgcgtcgcctttgacttttctccgacggtaaatttattcgtcacgccgtcggccgcatataggactgtctacggatctgagtgagcatctctcgggcggaatcgccgagccgacgcagcttcgccaccagctccgcggcgttcgacgccgggcaccgccgtgcgcacggcagcgaacttcctctgctcgcactgatgctgccgctacacatcctcctgcgctccttcgacgaaccgctcgaaccaccatggtggccgcggcgttcgacgtcggccaccaccgtgcgcagggcggcgactgcccgtgctccaccttcggcccagcggacactggcagacaacgacgacatcacgcccttctatgttgttgcctcctccggcggacgtactcctgcgctccttctccgacgaaccatggcgctcgaccaccgatatgaagacaacaactctcctgttcgacgaaatgtctccaaagcaaaatagagatcaactatgttttttttgtccaataagagtttatgttacaaaacatacttagatagcattttcttcggaaaagaaatattaccaatgtcgattacataatgtaattattttcaccagtccataattcaatttcgattgcgtgttcgataaggaaaatatttacagtacaaatgtctggtaacttatttggctaaatatgaagaagagtaatttcaccataaaatgaatatatattatgtagcatattttaatttcgtaatatacgaacaattttgtagaaacgatgtatattgtaaaatcaggtacataggaccgattttaggggataatgctggaaatgaagaagatatagagaacaaaatcttttagagtgtgtcgtaaaagacaaaatatttttttatggaacgaaatttagagaacattgttgagatagggtcgaaaacgagccgagctgctcggctcgtctactcaccgagctgtaaaaggaggctcgactcgcgagctgcaccttgaaactaatattgcattatatagtgaattaatagtctataaatgtaaaataaataatcataacacaacattataaataatctaaattatacttgttatatatccatcattaaagactaaaaacaagtcaaatatctataaaattattcaatattcatcattattatataggttgattaattttgtgcagctcgcgagccaaagcggctcggctgctcgttgattcaacaagctcgaaaatctgactcgcgaggatagcttgacggccactgacacgtggacccacctacctcctcgtgttgttctccgtctcccttgccgcgtgtcgtcttcccttggggaaaggaaaaggggaagttctcgccagcgtgctgccttgcaagctgctaactagaataggaatccgacgtcgcccccgcccccccctgtgaaaattcgtg

SEQ ID NO: 13129 - DNA, 864 bp, Zea mays
cacgtcatatttctcaggtgtcatattatgctatgatcagcagttaatgtcaggcaccaaaccactatcccatcttcagtcatatcaaggctacagtatgcatcttggtgttcttgcaacagcatgacatgcaaggaattatgagcttggttaaactatttctgtttctgtgttcatttttagttgcagggctattgcaatccgttatttaattggtgcatgattcccttgtttattataaaaggatgattttggattatggataacgaattgcacgtttgagccgagttatttacactcatccttgcaggactagtccagctgaatttgtggtctcgcgagtaggtactatgaatttatggtcgacgccgagatccatggcgtctaggtcggcgccgatatccacggcaccgaggtgctgccacatcagatccacataggcgtgagctcttaaatgtacacgccaaattaattggcgtcgacacgttgtagttcgacgccaatagtgatgacgtcgagataagggtccaattttttgaaatggaactgaaaaatgcgtatttgtaaaaataaaacctaaaaagggtaaaatgtaaaaaagacgggcttcctcccgcgattcgaatcggaagccctcgcattccgaaacccaccctccgcctcaagaagccaccgctccgacgagccgtgggtggcagaggacgcgcagagcaaggtcggggcgggggtctctgcaccggcaatttctcgcgctgccgccgctgaatgctatcggagtttcgggggatatttaatgcggtctcgttgattttctcgtagcctcaccgctgcaggcgggcgcgcggacagcgtcccgccctcccy

SEQ ID NO: 13130 - DNA, 735 bp, Zea mays
cgcgctgtgactgactgacgaacggtgatgctgatgagctgagagcttcactcactctggtgttgttgcagacgctcaagaagaaccatcagaggccgctctacgaggcgtgagcccccaaaaggcacaagtgctaggtcctgtatatatatatatatatatgcaagaagcaatgtatggaaaagatgtgtgctttgcatgacactgaacgaagaagaagaagtagaaccggccgggccgtgcggcgtacgtgcgcacaattagttcctatcagtctcagcggagaattacagcgcgaggcgtaatttcatttcccgtacctgcagctagctagccttgcattgcttattgccagcaatgtacgtaatcaccggcagcaaaagaagcagtaaataagtacggctcgatgcttttttgactagttgccacgtgattgtgatgtgatgttatcctaacttttttcagttcatatgactattcttaagtaaaatatagcacagttagtcgcgaaccaaacatggagacctataatctgctagctagtaggctctgatccatcccgtgctttttggccactatatatagagagagactaacgctagctagctagcttgcttgctctctaacacgcacagacacagtcacacagcgttgcgcgccaaggagagagcttattgcaaattactctgtggaccgaaccggtcggtcggaataataagcagcagagagagagag

SEQ ID NO: 13131 - DNA, 938 bp, Zea mays
cttaaaaataactgactacttttaaaaaaaattgagcagctcgaagaaaaacttctgtccatatagtcttgaaaaactctattttagaccgtgtttccatgtatatgatgttgtgttctggagtactcgaagtgattgaaaatatttatttacagttctagttcagtttggtaatgtcacaataaaaaaagactgataaaattaggtatcctgtgcttaccaaaggagaaaatgaggaggtgtttgttctttcgactgaaatttagttagtgtcatattatatttttctagtctttatctttgtaattaattttataattaaactatatttaatatatatatatttattatttaaacgtctaatataacgtggatgaaagtttagttgggtccagacaccctataagagaggaatcttagacatagagacgcaaaatgttttgtttaataggtccgtccgtttataaatatatgataccattatttaaaaaaaatttgatcactcgttttatttaaaagaatagtgacttatcatttttttatttgttttatcacttaaagtttgtgtttaacttaaatttttgcatttttaataaatattatgaataaaatgagtgattaaagttttcaaaaaaaggttaatggagtcatatatctatgaacaggtaatactctttaggaagaagtacttgaaaaacaaaactcgaacaaaaagaaaaaaagaaagaaaaacggtccaccacaccttgtatgtgccctccggcgggcgggtcagagctcgcaactcgcaccagcacagcagcaccggcagcaccaccaaccccagggcagccgcgccgccagccacgacaagcttagcagcccctcgcactcgctagggtatttattggtacaatcgggtgatctgcgtgccgcatcgcgccgggacacgggagaca

SEQ ID NO: 13132 - DNA, 84 bp, Zea mays
ggtgcgataggaaacccccaatttgcatgggtgacttggcatgctttcatgaactgattgaagatccttttaataatatagtgg

SEQ ID NO: 13133 - DNA, 954 bp, Zea mays
gattttttttcttttttttttctcgaacaacgcagaggtcagtctcacagagagcaacttctaaactgcacccttgaaggattttcatgctccattctatttttgtttgtatacatgggaactccaggatactctcacatcgcccttgccactacagcctacaataaagatttgcaggtagcagtcctgcagttgctgcttgtcattgagttgtggtggcttcctagggttatggagctgccatgcttgttggctgttgccaagactggattccaaaagctgccatctcctttacgtgccattgccttccaccaaagtccacgttgtttcctccagccgcagagctgcttcattgtatgaactatgaagtatcctgtttgactgctagcatgcatttgatgtttgggatttatattttattcacttggttctcatgattctgttactgtggttcactgatatccaattgaagtgaggatgattagtcatcccccttttttgcttgcttaataaaaggtagaaaaatattacatatctctaatgtgcccaacttgtggggtgtaggcctgctggtgcagtggtgagagctgtcttattgagtcatcaggtcacgggtttgaagcaacgtctccgcatttgtgggagaagatttgtcttgatttatcccttccttagatcccactcatgtgggagccctccggcgggtctgctctttagtgtgcccaactkgcatgggattaatattaaagagtcactgttgtttgctcaaaattcttccaaacagcttttcaagcttgtcgctttagcttgttttctgggcttataaggtagtaaaagctggtttacaggataaactaagcttggccagaccaacactctgagctaggcatccaagtgggtacccagtgttttctaggtcagctagtttagttcacttcttctcctaggttatct

SEQ ID NO: 13134 - DNA, 183 bp, Zea mays
agtaactgaggatacaagccaagatatcatgcagggggtggattggccaggggagtttttataggcacaatttttgttaagccagtatcagatcctcatgttgaatcaagcctcgtacataaagtcaaggcagaagttcatttagttgatgaaatcacagcagcagatttgaaagctgaaaat

SEQ ID NO: 13135 - DNA, 524 bp, Zea mays
agcctttttagtaagcctgctcactttcccagaagcaatgctgggtgagtttaagctagctcctataagaagtcgatactgctatatattgctattcacttacatggcagcctgatagtaatctgccagtcaccacaataatcattttagttgacatgccttcgactactggataattcctaacttaagcaatatcctttggttcctggtctcatgctacataactgtgatttgcgagggcattcctcagtaggcagtactgcaggagcactggttattggagtcaggaaataaatcaagtgtctgtagcccttctggtctctacacatgtttttctccttccttttggagtagcccgtttacattattaatacaccaaaaccacttttgctgtggatgtcaagtttatctgatagatttgttatttagaatttttttggtgtatcctaactcctaagcttactaatgctgtggacaggaatagagatttactttttagaagaatctgctaatgaacaaatata

SEQ ID NO: 13136 - DNA, 1500 bp, Zea mays
tgtcaccctgcctagtgtggttccttatctgacaccaactcacaactcggcatgaaacaactgatttttatagtttcctgtagatcaatatgaaagtgttttcctcgcaaaaggggaaaaaagaagagatactgaaatttagtgcctatagtgttcttctggacccagaccctagaccaccccactcaggttggagcctccggcactggctctgcctttttttactgttcttttagacctgatgctgaatgactaattgactattctcgttttgatattctgtaacgtcttcgcgttttatcttgaggtttgtggatacagagaagcatggtgactcattagccacttgcatgcttcacctagatatgattttcgcggctgtcttatataatggtctcatgggttggagacagtgctgtcttattgcatattcacggaagagtctgaacagttaaggggtaccatttaactgcttcttcttttcagctcaatactagtaattttttcgctattaatctgagatatcctcagtcctaactttaatctagtactgttgatatcatgcattgcccttattctttgaaactttgaaaaataatgagggactatatgtttcacaattcttgcatacacctaggggtgataatgggctctaaatttcacactacgaattttaaggatcgtatcattttaggatcagactctatttcaattcatttttaaactaaaattaattaagagttcaaacgaatcgtgaagaaacatttggatcgtaatccattaccacccctacatacaccggtccctttcatagtttttgtgtcttgacaatgaaaacgagaggatcttttggtgcactattttctatgtttgtgtgttaacaatgaaatgagcatctgatgcactatgtttcaatgctatattttatcttagcaccagtattcaattatgcctagagccctcgacattttatgacctgtcaatgttgagtgggcataatatctcctgacagacaatgttatgatgtcatacttttactcatgatggttggttggaatatgcatttttgcttattctaaattttataaatactctaatcattgagatatagtaccgatgtggttcctgaaagcctagtctttgtatggttgcactgcactctgtcaagccccagtgacaaacatatttttaaacaagtcacttagggtgtttaaagcgagtttcagttccctttgggagtactgcatgtttggcatttttctgtgtgtttcttttgggtgatgtagctttcatacttttattcgtacgtgaatggttgattggaatatgcattttttattattctaaatttgagaaatactccaatcattaggatayaataccaatgtgactcctgaaagcctagttcttgtatgattgtattgcactctgccaaacccaattgagaagtagttttgtaaacaactaacctttgggtgatgaactggtttctctcgtgct

SEQ ID NO: 13137 - DNA, 320 bp, Zea mays
gtcaatttgggtcgcgtcggccattttggaaataacgggcgagtgatgacatggcacgccaacattttagaaataacggctgggtgatgacatggcacgccagcgttttagaaatacgtgctgggtgatgacttggcacgccagcgttttagaaataacggttgggtgatggttgggcactttttagaaatggcctctggcccgggaaaaccccatatgtactgcactgtcgcacgcctccacgctccgtgccctagtttctgcttttctgcatccaggctttctctgctttcctgcaatattgcttccgctcggttgag

SEQ ID NO: 13138 - DNA, 629 bp, Zea mays
ccaggcaaccgaacggggccttagtagattagtagatacattccagcccagccacaaccgagtggggtaaccaaagacaacccccgccccacgtccccacccactcctatattcccttctccacgattacgaacgaccccaactccctctggagtgctctggaccgccctccccaaccaacggacgacgcctccatccagaattattccagatcacgcctctctctctctctctctctctctctctctctctctctctctctccgcgtcgtcctcggtctcctcgctcgccgaccctgccccctactgaactgccgcgcgcgcgtcgtggagtagagatccctccgtccggccatgaagtgatcccgtggccttcttcatcgtctcttcattggtaagaataagaaccatgcgggtgtacgtgccctagcaaattccgcggaataacccgtccgaattgaatctccgtatcttccttttctggatccatgcggccggcgcatgttggctgacccgataatccctcgatctcaatcaccccagtacagcactcattttgtacgtatgtgtagatttcatcagcactgcgtgcatacaaggaggagaggagtccggccgctggcagcgaag

SEQ ID NO: 13139 - DNA, 914 bp, Zea mays
tcatcatatgtatagtaaatagtactatctctatatcaaaataaaatttgttttgcttctttagtgaattcatcatcatctagttgaatataaacataaaaatcaagagttaaaacaaaatactattttgaaacagatagagtattcgataagtaattgagacattaacttaataatctaaatgagactggtcgatagcgcaatcggtctttacatatttatgtctagaatagatagatttaatagaaaaaagtgctagcttctattggctaggtgtccctccgttttttggggcctggtgcggccgcaccttccccaccycagatacggcgttgagcgtggatctataagattctccaagatgtggcgtgatgcttcgagatgttgtggtgctcagtgatgtgctaggcggggtagcgtgcggatgactgcgggtgacggcactgaggcaggtgatggtggtgggtgagggcgttcacagattaagcagaggcgaagacgatccaagaagtggagccctatctctatcaaacgtggtgtaaggaaacctgtacgtaacccttccaaacgggcagctggacgtgtttttttatcggtggaccgcccgtccggtttcggtgttcccaaaagaagcgcataatttgatcatggataggttctcgtaacaaaatgttttttttctggattccgaaggaaaaaggacgaacagagaacccgtgttttaacttttttgtttacacacccgccgtacagtgatgtatgctgtagtaccaccatcctttcctctagagttcaaaaatctactgatctagaggcgggccggcctcccatgccgccaccgccgcctccaggaccacctcaccagcgccgtcgccgcggcgcttcttcgcagcttcgccctctggccgtgggat

SEQ ID NO: 13140 - DNA, 1500 bp, Zea mays
ttggctatatatgtctgtgatgatatgtgatgtatatatgtgatatctgtgaaatatcttttgtttgtttggatggaataggaaaaacaaataaaaaaggtgtgtactggtctctttgccgagtgacacactcggcaaagaggtgctttgccgagtgtcaggaccatagcactcggcaaagaaccaagacctgggcaccggtacaggttctttgccgagtgtagtggctctgacactcggcaaagaggccttctttgccgagtgccatccagaagcactcggcaaagaacctgacatagggaccccgctgacggattctttgccgagtgttggccggcagacactcggcaaagataactcctttgccgagtgtcacctaagacactcggcaaagacgccgtctccgtcacccggcgccgtgacggctgcttttctttgtcgagtacttcctggcactcggcaaagtttttgtcgagtgcccgagaaagagtactcgataaataaggctttgccgatgtactgtgtgccgagccctttttgccgagtgtgacactcggcaaagactttatcgagtgtttttcaggctttaccgagtgcttcaggcactcggcaaagccgtcgattccggtagtgtatcatacatttttatcttctctcttgaattaaccttcgaagaaaagttacgaagggaaaagctttcaatttaatagcttgaattgtcttgttttctatatcctttaaaaatgaaaaatgagtgaccaacaatgtcttaatagtttctataggcacctgtgaccagcggagcgagtagatccgatattgatctgctggaaatgtcaatcatgcccctgactgcttgaaacatatacattttacatatagctatctctgcctagaaatgtcaaccaggcagagatagctaaataaaaatccctaaaaacatatacattttacatatagagcttgctaagattgtcaagcacatggctcctcagctttactgtcaaaaggattagaggagaggcctgcagcttccaattgctatggccatggacatggtggtgaggagatccagacatcggggaccaacagtttcagtattgtgtgcctcaactatagtttcagtatctccagtctaatttgctccactgtcatcaagcactcactcacattgcctgctaggtaatatccatactgaggcaagaacaaacattcagacagcaggtaaaccatgttaccaggacttcctgctcacacacaggtagagcagtatccatttacttcatgatgatgaaattcttactgttctcttcaggtccacgagctgccaccatgttgctgtataaataatatttagtgtcaaacatacaatattgttaaattgcaattagcatgctttagatcttcaacatagtgattttagtaacaagggaaactatgctttccaactcattttatcttggtaaccatgggaagtagtacaggggtcttgttaactgc

SEQ ID NO: 13141 - DNA, 800 bp, Zea mays
cctgcatttgtgacttaacttaccatatagctgcaaaacacaagttagtcacaaaaatatgtgttgtcattaatcatcaaaaccaacaaggggcctaaatgctttcacttaccgtttagaatggagggatgggtactaaagtattgtagtagaatatgaatagattggacatatggtcctatgttattttatccatggatttcgttctaacacttgtctgttttacttaaaaacactcgtgtatgcggaagagtgctgtttaatataatggactagtaggacaaaataatacagaaattatttggaccagcgccgaggaagacaattcgttttgaatgaatctgctgctggctgctgagtagtcggacatagagaatccttctagacacagcgacgtgccggtgccccagcaattcattgtggcatttcgcagcccacatcaaccccttcacacgaaccagatcagaaaagccactactgctttctctctctctctctcacacacacacacagacacaaataaaaagaaatcagtagttcgatttctcctctcacctttacacatatctccgtatttacaaattaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagca

SEQ ID NO: 13142 - DNA, 1500 bp, Zea mays
agcgtgtaatgtgttcctagttcctttatgcacagcgccacaccacaacctcacagtctctctcacacacacacctgcacggagtgccgtagttatgaatagtgtaccggatattgaccactgcgcagatccggtggtgccgccgaatgcacgggtctcgaggaggggcggcacatgcccggcgcgtgaggactgaggaacggacagaagtaataaagtgctgtgcgcttgtgcccagtggatcacggcgcatccactaatttaatactactattttgacagcagtgacgatcccagattttgcatctgggtgatggtggaagagagaaggcctcctcggttcaacccgtttacccgtggggcaaggcaatatggcatggtgctgcctgctggagttctaaaataaaaaaaatagcgtggggggaaaagtacgagtaggggcagtggggtgcgaagcgggcgaggcgaggccctgttgacgtgtgtgcaagtacaataccaccgtccatccagtgagacttggggggccggccacctttgtggcttcgtcacaaggaaaaaagcaccaccgcactagattgacatattgtactagcactctactagtagtaataataagctataagcacaccaaaatataaatttttttaaaaaaactcaagagggcgtggaaaagcaaagaaagggccggcccatccgccgccaccgccgcaggacagaccccaccgattccctccaccactgtactccatccgatccgacgctgcagcgcatcagcacgggagagggaggggccaagcatcggcccattgatgacgattaaacaatttctctcagcactagtactacaatcatacggtacgagtttggtcagctgcatgaccaacacgcttgcctgcctgcctgcctttctttaaccaccaatccagacgtctaatcgctcgtgatcaccaagctaaacgcgcacatcgacgcaattaaggcgcccgtgacgttgctgttcggtcgctgcctgcgacacggcaacagcgtagccgacggtagccgcggcctcccactccgtccccgccccagtacagtacagtacccgttgcggtggtcggtctccgtccgcgtctacgcctgcttcggccggacaggctacccgacacacacgaggaggagccgggccgggctcaagctcaaccgcgcgccatcattgctgcgcgcccggcctctacttcctacccggttccttcccttgccacacgcgtgcgtgcgtgcgcgcgcgcgggcgcacaaataatcacgaggaccccgcgaggccgcgccaccattattccacttgcctgactcctctgcctacctctctctctctctatctctcatttactcacgcacgtctcgcaactgccgcggcacaccgcgccgcttcttctcctcctcctcctcctcctccttccgagccgagagaaaggctgctgccagagggacgaggacgagcgaggatccttccgagcg

SEQ ID NO: 13143 - DNA, 866 bp, Zea mays
agtagatgaataacttgtgcatcacactgacgcttccagaaagtagtgcccgagtaatatggtagtcggtatcggcgtttggaaacaacaccgagcgatttgaaggtcgacatcagcattttggaagtaacaccgagcaatcgaacacgagatcagcgttttagaggcaacgccgagtaagtgaaggtcgacatcggcattttagaagtaacgccgagcgatcgaacacgagatcagcgttttagaggcaacgccgagtgattgaaggtcggcgtcggcattttagaagtaatgctgagcgattgaatacgaggtcagcgttttagaggtaacgccgagtgattgaaggtcggcgtcggcattttagaagtaatgccgagcgattgaatacgaggtcagcgttttagaggcaacgccgagtgattgaaggtcggcgtcggcattttagaagtaatgccgagcgattgaatacgaggtcagcgttttagaagcaacgccgagtggttgaaggtcgacatcgacattttagaagtaatgccgagcgattgaacacgaggtcggcgtgttagaggcaacgccgagtaatagccggccgcacgagttattttgaggataataaccgagtgatgaagtggcacgtcggctttttcggaaataactgccagatgtccacgtggcatgctggggtttcggaaataaccgccgggtgatgactgggcactttttgaagcggtatctggctcaagaatatcccataagagttgcgcttttagccgcctttgctttccgtgccctagttcttgcattcccgcatctgaatcttctctgccactcgcctcctactctgttcgccggtgaaaagcaag

SEQ ID NO: 13144 - DNA, 81 bp, Zea mays
ttttgaagttcgacaagaatacgacaattcacaaggtacctggggaaaagacaaccttgtagccctgactcaagtggacca

SEQ ID NO: 13145 - DNA, 321 bp, Zea mays
agtaagtaattcattcacagttgatgcttaacatggtgaagtattacagttttactaagtggatttgacgatttgtgcattccattgttttttttttctcgaaaacgcgcaggagagctgcgccgtgcattccattgttttgttctaatgtctcctggatcaatggaatgttcctttcctatcaagttcgacacctatagctttggtgtttaactaatggagtacaccaaagatataggtttaaactgttaaatatctgtagttgtactaattcaaaccgtacattccatttatttctgaaatgtttcaaacaacggttac

SEQ ID NO: 13146 - DNA, 398 bp, Zea mays
tgtggcatttgtccagtttcttcagtttgtcaccaattgaatgaattgatgatgagccagggtgttgataaatgataagtgataggtcgatgtttgcttatgattgttttctgctttgatttctcttctatgtgctatcacttgctccttgttttttattcaactcgtgtatactctgagctgtataaatgatttggtaagatgcttcgtgcatgctaattccccttgtgcctcacgggtattttttcatagatcattaatgccttagtggttctggtttcatgttcttaacgggccactctgtatggtattatttctgttgaaacgtttagtttctgattgaccaatttggtgattttgtgatacttgataggctataagctgctagtgcttgtgga

SEQ ID NO: 13147 - DNA, 415 bp, Zea mays
gagatatatcaaacggacctaaatccttttgtatgaactatcaactgtgataatgcgcaatgtgacaagcacatagctcaacctgctttccctatgtttattattgattgttatggtttctgccaaacaactaaattgctatcataattgtctaatcatcactcttttgggacactattgttttcattctaaaatttacatattttctccattgtgtcaattttttttattatatattgaacaagttcttgtcaggttgctgtaaagtgtgctatctggactaaagaactgacaaacttccattaccatttgactctrcaggagaacagctcgtcctaggtcacttcttacagttgatgagtccgtgaaacagcaacaacagtgcaaatcgctcctttccaatgggcaaagccac

SEQ ID NO: 13148 - DNA, 96 bp, Zea mays
tgtaatatatcgtatttctattgatttacagcgaagctagtgatcatcgctaacaactgcccgccccttcgtaagtctgaaattgagtactatgct

SEQ ID NO: 13149 - DNA, 91 bp, Zea mays
tgtaatatatcgtatttctattgatttacagcgaagctagtgatcatcgctaacaactgcccgccccttcgtaagtctgaaattgagtact

SEQ ID NO: 13150 - DNA, 467 bp, Zea mays
tttaagtgtgatctctgaatctgtccaaattgggacagcagagcctttctcgtgtcttttgaccttaatatgcattgaattaacttgatatgtttataaatgaattatagacaattctactagctttctaaaaagtctgggagcacctgaattggatgattgagactccaattatggattttttgaattgagtagttgagttatgtccaagtctggacagaatttacgtttagcactgtttgacctttctaagtgtcaaatcttgttgtgatgataataccaagggtatagtggactttataagttttccataaagtcctagtttactaattttcgatgcatattttgtgagttaggagcaaaacaatcaaccactgtgctgctatctagaaatatgcaagcattaagttgctctcttgaagttgctcttgtgtggctaagtttggtttaggctattggagcacagt

SEQ ID NO: 13151 - DNA, 768 bp, Zea mays
ggtaagcagtattgagttgccatgcctcaccgcctcaccttgtcaccctgataaccatgatattttcactggtgaacagtgctgtgagcctgtgacacattatgcctatatatcacaatttggttatctcaacatctagaggaactactctgtgttaagtgtgtatacattgtactaagtcccctgcaaaaaaaagggcagcccggtgcatgtgctcctgcttgcgtagggtccagggaaaagtggacccatttccctgcattgcatgaggctgtttacacgactcgaacccgcgacctcctgttcacaaggcaacagctttaccagtgcaccaaagctccttttttatactaagtccctggcacgtgcgattttatttaccgtgcctccaaaatgcatccatgtttttttttgaggctagcaaagtcacttaattatttttgctttgaacatcttgtagaacaaaatgttttttttataaaggaagcttttattactttctcatgagcagtgcattgagttgatacagagcttttaaaaaatcacttctggcttctgtttttcaacaaaatgttgcacaaggaatgctgatctaagtttctcactgcagatcttgataattgatatgttacgtattaatatatacttctgatagcttctcattgccactctttaccgctgttgcaggattacaatgctaagctttcagactttggtctcgcaagaacaggtcctagtggagaccaaacccatgtgtcaactcgggtc

SEQ ID NO: 13152 - DNA, 1017 bp, Zea mays
agtatatctaatatgaattggggtagtcctatgcattgtggatggcttacttaataatacttaaaaaaacgaattaataatcgagattccttgccgatactctactctaataaataaaaaagaaataaaaaaagaaatcatctatttaatgaatagcataagattcattgagttcttgtcgcactcctttgtgaaagagtagaatgagaaagctagtgaatcttaaacccattgataaaagaaaaaaaggataacaactatggttagggaataaaagagggtttggggatagagggacttgaaccctcacgacttataaagtcgacggattttccttttactagaaatttcattgttgtcagtattgacatgtagaatgggactctctctttatcctcgtccgattaatccacttttaaaaattaaaagatctcgaaaacaatgaattaaaggatttgattactcaatatttgattggaatagattcacaataattctaaaaaaattatgaattttctatttcataatcattcctaatttcattctaaaaataaaataaagaacctatattataatatgggttctgtctcgatcctttgcatatgacccaacaagccaccacagaacctctcacgtagcacttctcttccacccaacacattcaatcctcttcctttgccactccccattaaagaaaaccaattgacctcccatccctctccccctataaataaccagccatctcttgtccagcaacaccaaaggaacacctctgagcattctaaagctcatagtcctctcctcccagagcatttcacatcggtctcatctccacctgcttgtatccagcgcctcgtcactctacaaaacagtaagtcccctcgctatctgtatctaggcctctaatccttgtaacagtatagcatccattcttaagtgtatctcaatcagctgatttcaacgtttgatggatgcagacaacacatacttccaaaacacagcacatacctccaaagg

SEQ ID NO: 13153 - DNA, 1500 bp, Zea mays
aagcgtggtccaaaatgtcaaaaattgaagaaacaatccatgcgtatcttataagtatttatattggttcaattccaagcaacctttgcacttacattatgcaaactagttcaattatgcacttccatatttgctttggtttgtgttggcatcaatcaccaaaaagggggagattgaaagggaattaggcttacacctatttttcctaactaattttggtggttgaattgcccaacacaaataattggactaactagtttgctctagtctataagttatacaggtgccaaaggttcacacttagccaataaaaagaccaagaaatgggttcaaccaaaaaggcaagggacaaccgaaggctgccctggtctggcacaccggactgtccggtgtgccaccggacagtgtccggtgcaccaagggactccaagccaaacttcgcacctttgggaattttcagaggcgcttcgctataattcaccggactgtccggtgtaccaccggacagtgtccggtgctccagaggagagcgactctgaactcgccagcttcgggaatccgctccgctataattcaccgaacatgtccggtgcacaccggactctccggtgagccagcggagcaatggctacttcgcaccaacggtcgtctgcaacgcattaaatgcgcgctagcgcgcgcagaggagcagagcacgcgcgggtggcacaccggacagtctacaggacttgtccggtgcaccaccggacagccaggcgggcccacacgtcagagctccaacggtcggaacccaacgacctggtgacgtggctggcgcaccggactgtctagtgcgccatgcgacagcagcctccaccaaacggctagtttggtggttggggttataaatacccccaaccaccccacattcaagtcatccaagttttccaccttccaactacttacaagagctctagcattcaattctagacacactcaagtgattgaatcctctcccaattccgcacaaagccttagtgactagtgagagagatttgttgtgttcttttgagctcttgcgcttggattgcttcttttctttctcaatctttcttgagatcaaactcacttgtaattgaggcaagagacaccaattgtgtggtggtccttgtgggaactttgtgttccaattgtttgagaagaagaagctcactcggtccgagggaccgtttgagagagggaaagggttgaaagagacccggtctttgtgaccacctcaactgggagtaggtttgcaagaaccgaacctcggtaaaacaaatccacgtgtcacactctttattcgcttgcgatttgttttgcaccctctctctcggactcgattatatttctaacgctaacctggcttgtagttgtgattaactttgtaaatttcagtttcgccctattcaccccccctctaggcgactttcaattggtatcagagcccggtgcttcattagagcttaaccgctcgaagta

SEQ ID NO: 13154 - DNA, 501 bp, Zea mays
ggtaagcctcttttacctgcaatatgtcatcaagaattatagttgtatgcagcacttggaacaaatttgacaattttgcaaaaccagctcagttgcagacaatgtaccatttactacctatattgatgggtttatggtagtctatcctcttgattgtactcagttggcacaaaaaccttctgtgtaaaaccttaatagttttataccttcttatggaaagccttaccaaataccaattgtaaatgccgattcttctatatgttcaaatctcaaacccaaagaatcagttttatctggttttgctctagatttagaaccacctttaatcttgtagggaatcgatttataaatttgtagaaatagtcagatgatctttctgttagcctttggtatttatatgcagaatttttactttatgagggtgtgcaaatctgattatcatgttacattttatcttatatgtagatctgggatgcaactcgttgtaaaagaataagaact

SEQ ID NO: 13155 - DNA, 730 bp, Zea mays
agcgagctcgtcgttgcgcctgtattgtacacacgtgttttgctgtaaattcatcttgttctagaagacaagacacggcatagatgagagaatctggatggctgtctcgcgtcggtatccggcggacgatgccagccggcagaagcagtttgactttgacggtctcggattgcggtccattgttccaacagatacgatgcgatccattgcgataacattattcttatactctatcatgtaaaatgcaagaattgccaagatgttctaagatcactcgagttctggtcatttctaagaaaaatatatatatttttaaaatgtaacaaaaaccctggatcgaatcaaattaaattcgacgagtttcggtaggatggacggctgtgctgcctgtgcattcgagacgcctactgacatgttgaccccacatggcagccagagaccgaacggtgtagaattccgctacgcatattcgccccctcttctctcgttttcttcttttgccccggaggcgcggacaggtgaggtaccagcaccaccagagcattccgtcccgcccccgcctccacctcgccgcgaccacacctcctctcctccccgccggctcctcctcctcgcatggcgacagcctctcgtccctagcccccccagatccagcggcacgcacctacacacgcgcaaggaaccgtagacgcgcccccgcgcctcccctctctcccgtcctccgccaccc

SEQ ID NO: 13156 - DNA, 576 bp, Zea mays
gcttcgaagttttttaggtattcttgacctaggtctatttgaactgaattacaatgggcctggatcgtgtcaactcgacacttctcaattctcagcactagtgttacagtattttagacggcgtgagtagggccgaaattggacagaaaaaacacatcatatttgcttggctttaatcaatatcgacttctactgctcttacaatattttgtttctttagattatagtggcagcaatcaaatagctgtttaatccgaagctaacagtaacacatgtgttacttgctactctagtctagagaaggagagaggtcaatggatcgatgggatcatgggacttggtgctggcgtcagtagagtcgtggacgccattcccgccaccagatttgtggacgacgtagcgccttcctctgccgcgcacggacccatggcgagtcagacaactcttcgtctttctttcttcttcttctcttctccactgcacatcctcctttcttcttctcctcgtcgatcggcaagctaaggaggcaccattgcttgtcgtctgatccccgccgggcgcgtgtcgctgcacaag

SEQ ID NO: 13157 - DNA, 164 bp, Zea mays
ctgaaatcacaacattgcatatagtgacatgaattcaaaacatagataaggcagtgtccaattcttggtaaactagatgtaaaatctactgcttgatatcagccttcttcttctgccacagcctgtccaaggagctgtctgcgtcgccctgtgcacaacaaaat

SEQ ID NO: 13158 - DNA, 1238 bp, Zea mays
gctaggcatgctgcttaatcgagtacagtgcccaacaaacagcacgccttttcgacacgaaacacttcatccaccagcgtagcgtttgtactcgtgcatggccttcgttcgccatggatgcatggtctgtactcttctacaagcaaattctgctacatggcgcttagccaacgttgtgtacttgtgttgccattggttatcagtacaacgctacggagcccataaatcttcaataaaacctcctttaaaattttatatgtacacaatataatgtagaaaggacttctctacagtagtttagttcggtctctattaaagttttttttttgctccgtccctgtactactatggagatttagttggttgtcagcacatctgaacatcatcacattgttcttgttcagcagcagttagccagcatcagcagaaactgctgaagctctaattggttcgtttgccgaagcagttcgatgaccatgcttgctgccccccgaagccggagagtttctaaatgaggtcggatcaaacggcctgcaaccaacaaagattctgaatcctgcaatgacgtagcttagccgcgtttattgtgcgtgcacactgagagtactgacaacctcatcatgctgatgagtcgttttattgagagtaaaatgcataagcggtttttgtcacatcagagtcaattaggttcccgaacttagaatgttgtgtcatttagtttcgcgaacttttattagtgtgctcaacgtggtatgtcacgtcggcgtatgatctgagaaaactcggttttaaacggtttcgcacgaaccgaccaaattacagaaaccgtttttctgattttaagtttggggatataagtgacgcagcgtgtcaagtttgaggaccgcttcgtgtattttaatcttttattaatttagttggacaggatagcaacaggaaaaatcgagtagcagttgaggattgcgcattaaagtcgatttgttcttaaggcccacttgcaaacctaaccgctgataatgccatgatgtatatatatgattaggttaaggattgcgtaagacatgatctctgcatgtcgctgcctggctgcgtctcgtcagatatatgcttgcgtttgtatgactagacactagagtgagagctaacaggggcgagagagacggccggccggccggccggagaaggaagccattcgctgcagctgcaagcaggatagtcaggagtagcgtgcaacggag

SEQ ID NO: 13159 - DNA, 1500 bp, Zea mays
cgatttgtttcaacaaccaagtggattttgtgttgctgactgtttgagtatttttaatctagattataagttattttttttcaaatacataaaaatcaattttaaaattataatatagtttttcattcattcatttttttaaaaaaattggtatatcgaagtttcatatatcagtcactaagactatttaggctttctttggaatgtagaaattatagagaaatcatacatgaatttcacatgaaccagtttattttcatatgaaaaacataggaaacggtaaaaaaaaattcccgcatcttttttctcgcattctaaagagggccctagtgttgaacacaatatagataagttgtattctaatctaataaacctataatgatatacctttatctatatatggcatataaacttatttaatatcaataaaaccccactaaatactggcctaataacactcgttcgattccataaatatcaccgttttctttgtaaactttgctggttatagtataatttgatttaggataaactaactccttgtatattggggacaaacagagtgaatattgttttgttgcaagagccccaaaaaagttcaaattctttctggcaacccaatccgtccacatccttcttttttaaataaataatggttgggggctccattgctccaacattctctttcttgctaaggttgccgcaatttttaattttcgtcgtcgtgtgtacactcctcggtatccgcgacatttctctcgccactagtagtacggggcaccagcgtcccccccgcactacagaatatccgtttcaaccgcatccaccgtccgatcgccaaatccgacggccaccgttttctcccgaattaatgatcgtccgacatttccccgaacacgatgcgcccccccggaaaagagacggaatactggtatttattgattatctcctgcccaacccactctaccatttttcctccgttccattcttctctcctcgcctcccctcccctcctctcttgaaccctccgccgctccgaggaaaatccgatttgaattgaaaatcatccggagacagagatcttttcttcctcgaagctatcttctctctcgactcgatccatagctgctcgcgtccctgttcctcgccggctggcaagtggcggcgacgggacgaggtcttcatcgcctcctcgcgagcgacgatcacccactaggtacgcctccctttcctgtccattcctgctgtgcggaaccgagtgccaccagcctatatgcttttggatctgacccacttacttccacttaactcgattttttggcgagaattcctatactgtgctgtgctcgtccctgatctgtaggtagctcactcagctttaatccgccttcgtggattggatgcaagctcgtgctagcttggcgttgaattttctcgaaccttggatttcggctttgagatgagctgtttgttcttcgcagtttggtcggtctgaggcac

SEQ ID NO: 13160 - DNA, 581 bp, Zea mays
agccagagcatcctcatcggatcgaaatgcgcgtcctttttctttttggagaaaaaaaaacacagcggcagcttccattgttcaagttcgtgaacgtgaacgcgaaccaggaacacggtccggtggatgagtttttatcgagcaggcacggaaaaaagcaccggaggctcgtggtgggtgttcttctctctcctccccaccccgacatcccacaccgcctcttttgatctttttctttgtcacctgcgctctcacgtcaaacggtttccccctctctctctcctccctccgctttatcttttcctcggccctgcctgctttttaccacttccgcccgtcgccttccacctctcgcactccctccctccctccctccctttcactccaactcaagcgcagcgctgtaccgtacgtccccgactccccccttcttctactccactcctcgccgcactctccatgcccaccccgtgaaggcgaagcgaaaaccaaaaacccctttgctacatcactttactagctagtcgtccccgttctctccttggtcgcggcgccggacgagggcgacggcattgtgagat

SEQ ID NO: 13161 - DNA, 705 bp, Zea mays
ctggcggtgtcccttgaatcctcatctactgactcctctgtcctccattgctcctgcacatgagcctttggtgtatatagattgtatatgaaataacaaagttcacaaaaaattctaaaaaaatcatacataatctttccaccctactccaatttaaatgtattatattctttggtgcacataagttgtacatgaactaacaaaggtcaatgaagcttcttcccgtcactagatatttaattggactagcttcttcccgtcactgatacgtacacacaattctttgtgtccagacacaagcagctagcgtataattgagccttggtttttcatttcgtcatgtgctaatttgttccttgtgccatgactgaagttgttgaatcacctggactcaacgcggccgcgtcgacgacaagaccagacgttctggccccttcctcctgcggtgatgaccattgttggcacatgtatgtcgtcttcctccttaattaattaatggcatttatcaacgataataataactgctacaacaacaacaatttgcagaccagacgtatctcgtacccagcttcctaccaagcatttgttgaggtaggagcatgcaccgcacctatatatacgtagcggccggtagctctatttgcccatgcacatgtactgtgcactttcggcgtgtgtgagctgccctaattactaagaaaaacg

SEQ ID NO: 13162 - DNA, 101 bp, Zea mays
cacctcgtatcctcccgtcgccgcctcgccttcccctgcgctaccaccgccgctatctgaaccccagcgcctatccggtgagccggaggggaccgccgagg

SEQ ID NO: 13163 - DNA, 1226 bp, Zea mays
agaggggtgtagtggccgcgcaaatatgatattagtggcgattatcatgctaactgaccataggctcttgtatcgtttccttacaaagggtatctctataacttggtaaaatatgtcaggaggcaggggttcttctctggcagcagtcttcgctagaaaattagcttcttggttgttgcccctctcgatgtagtggactatgaagttatggaattgtttgtcaaggcttcgcactacctaaatatactgcagcagaacctcaaacttcatgcaaaattcacaagttttgttttgctggaatgtgataaccagtttagttccgagctgacttgttaatttgtaaaaaaaaaaattcaaacgatctgatcccaaactatgaacgaatcaagcgagccgaccagactcgtccagccctactgacgttgcttcgcttcgcgactccgtgataagcgctcgcgccgcctctctggctctcttccgacgccctcaccgttgtcgttcccgtttggccgcacgcgtccgccacaccccagctcgcctccccggctcacgtctgcctctgtttgccgcccttcccgccgccgttcccatctggccgcacgcgccggccacaccccagctcgcctccccgcccccggctcactgcggctcccgtctgcttccgtctgcagtcctccccgccgcagttcccatctggctgcacgcgcctgccgcaccccggcccacctccccggctcgtgaacgcctccttccgccgccctcaaatccgcgtcgtctttggcgtgacaatcctgtggttcctccagttgaacggtgacgagtacagcggattttggccttccgattcgattaaaaattctgtcgtgcagttcctattaaggtattgagttcaccgtactttttaatagttatatacttatattcctgctacttctagaaatgtgatcgagaggtcgtggagtgttaaagatgaagtggcgcattcttttgcacttgcctagttgccccgttgaaaagcaaggatccaaacagggccgtagttggtagaacaggctctagttcgtgtcttgtggttccttttcctttttttttaaaaaaatgggtgtattattgtcataaagttacaagtttttatggcatttgtacaggtccaacccatttgaaggcaattgaaaggccaaaacagattgattaaggtgccaccacctaacaaaaccaagcttgca

SEQ ID NO: 13164 - DNA, 72 bp, Zea mays
tacccctgcctgtggtgggttaatttacgttggctacgtttctattctgtgtactttgattatattatgtaa

SEQ ID NO: 13165 - DNA, 1400 bp, Zea mays
ttcggttctctaatttatggtacagaaccctttagagtgtgtttggttgcaatgacaggacgggatgagatagaacgatccctcaaattatgttgtttggttctggatcaagggttgagacagaattatcccagtgttgtcccctgtcgtccctcaaaatttgagagacgagacttagctgacccgcaaccaaacgagttccttgttggagctagtctaaatcaaccatcctctcggccttttgtgtcctggcccatctggtgctcacgcgcgtccggtatacaaggaccacccgtttggcgggctggcccgttttgtttcccgttcatcccggagcggtgaagcccatgatatcgcagccgatcaccattttttactggatcctgctcaccctgcatttctttctctcaccttctccgctttttctgtagtcaggattgtacgccgtgtatttcccgccgtagaatacatgataaaaaaaaagtcgtattgaaggaaatcgttcgaaaccgatccggctgcgcccatctgaagttctgaacttatctggaagactggaaagggataaaatgatggggttcaggtttggatttttccggtgaagcatacgagcgcatggtccctggcgcgcgaaatccatccccgtgaccgtgagcagatgccaactggcgctggcaaggtggacggggtggcacggtacaacacacgcagggtcgcagggaccacgtcggcacatgcctagacggctagacgccgccgcgttatacacacttgaggacagacgcaggcttcggaggcccggccggccagccggtcgatgcctatccagtatcgggccacggcaggcacggagagagcccggacacccgcgctggtccaggaggaggagaccaccggcggcgcggcgcgtagccaacccaacccaacaccgtgcatccgttccgcatgcctgccgcgagccccgccggaaaggcgttgtgaggttcgggtgggagtacaaccaaacaccaacccaagtacccaacccacccatcaacaaatcactccgccccatctctttcctttcccgcactgacaatctgccacaccgcggccatgtcaacatggtgctagcagtagtgtatgcaatggcagactggtagtggcaccaccacttcgacgctcccatcccccgtatccggacggcgacggggaccgggggcagtgcgtactgcctgctgctgctgttgcgcgcgcggacctaacgcgccctttccggtgtagtaaagcaaagcctcgccggtcggcagctgccctgctatcctaatccgcttgctctgccagcaagtcagcaagaggcagcagcgccggcccctggccggcctcggctcagctggcgaaggccgtgaccgtgagaagcc

SEQ ID NO: 13166 - DNA, 632 bp, Zea mays
gctgcaacagcaataaaattataaaaatgagaaccgtgttaataagtaaaaattcattaaatatttttcctcacgttataaagccgtggaactgaacaattagcaaagctcaaatgacaatcaaaatccaaatgccaaataataaatagcacacgctaagatccagataagttcggaaagtatcctcctcctaagctccctaatcccgttagaataatccccagtccccgccatccgttgtgtttctaccactctacagacaaggacagcccaacaccaccctgtaactactagttcactctgataggggcagcacggtcatttttacctactactattggcgggggtgggtgtctcccggtgcatggtattttaatatgagcgtgctttggaccaaaaggacctcgctggtgcattatagcaaacactagtatatattgctgtttcggtaccctacccccctctctctctctcctctacctccttttcctctaacctttagctttcctccctccctctcctctctcccccctcctctaacaagaacttagtcccggcagttcagatcctaagttgctgaccttgctgctgattgttggagatagatttgctgcttctaagttggaaatacc

SEQ ID NO: 13167 - DNA, 103 bp, Zea mays
tgtaagcttatgtacaaaacgatgagaattgaatgaccaaatttcagatttcagtttacatgctatgatatatcttagatacaaatggcaatgattcacctct

SEQ ID NO: 13168 - DNA, 89 bp, Zea mays
ggtttccttcttcctcacaattatttgtactgtaatatttgaagaggttttcgttatcattattactgcatgtgattctacatgtaggc

SEQ ID NO: 13169 - DNA, 69 bp, Zea mays
ggtgtgggatcagaccgcgatgaccttgtactccctgtgcggctcgtcgacgttgctccagcactggcg

SEQ ID NO: 13170 - DNA, 976 bp, Zea mays
ggatccccctgcatgcttgacttggactccacgctagtacagagtcactggacacacactgacacacacatatggactctggagtctggagatagagcatgctgccacgctctatttccgcggtacactgtacccggacaagtacgtcatgcacgaacaaatactggtaccgtacgtagcgcgtccttcgagtttgaataggagtagacgatcacgggctacgtccgcgcatatagacggaggtgtctccgcggcagccgagctagatgtcaacagcgtcctcgtcagatctcgcgcgtcgcgcacggccggggttggctgtatctgtctgtatccccacagaagccgtaggaaaccggttcagatggtcacgcctcctcgcggctctatcagcagtgacctgtcccgtttgggaaacggccggagagcaacgtcacccgcgcagtcggattctctgccggacaaccgaacagaaaaagagagcccgagttttcgtataacaccgccagtatctgtatctatccatctagctgatctgatctcgtgccgcaaaagataagtcgacaacaagcacgtgcggtgtgcggaatgtcgtcagggtcttggagtgcgtagagtatttttgttagccatagcatgcgacgacgcgtaggagagcacacaagatcctcctgctgttcgtaattccctgagtaaagatccaaacgaggaagagacgtccactcgctagagccgatcagtcatcaaaccagctgagcgaaccgcaccagctgcgactgcgacaagcaccacccggcacccgcacggccgcacctgggttttctcgacccatctaacccgaaccgtttctaatcactacgtccacgcctgcctggctttcgcatgcaggctttaaggacccgcgtgccgcgttcgacgacgcatcagcagagcgctaaaaggagtctttgcagttgcaggtcgagtgagatatgat

SEQ ID NO: 13171 - DNA, 344 bp, Zea mays
tatcatatctcactcgacctgcaactgcaaagactccttttagcgctctgctgatgcgtcgtcgaacgcggcacgcgggtccttaaagcctgcatgcgaaagccaggcaggcgtggacgtagtgattagaaacggttcgggttagatgggtcgagaaaacccaggtgcggccgtgcgggtgccgggtggtgcttgtcgcagtcgcagctggtgcggttcgctcagctggtttgatgactgatcggctctagcgagtggacgtctcttcctcgtttggatctttactcagggaattacgaacagcaggaggatcttgtgtgctctcctacgcgtcgtcgcatgct

SEQ ID NO: 13172 - DNA, 480 bp, Zea mays
gtcgtttgatataccatgcgtaaagaattgtataaaccactgattctttaaaacgactactatttagcgaaagagtacagctggtacaataatgtcaacggaggcctaacagatgacatccaatcaaaacttgcatgcttaattttattcaccatgatgctttttttttcacatcttccacttgcattcttttattcacttgcattttttttccacgagaggttttgcgtgcgcgcgcatggttttaggaaaaaggtctagatcagtggcaaactggacgccagcttttgggggccacagctgatgacagcttttaggaaatggcctagatgcgatcgagacgattgacagttattattatttcttgtgacgtataatcatgctttgtgacgtcagatcgccggcaactcgggcatccttctgagctacatcgccgcctttgcgctcgccggcctcccgacgccactcaactggcgcctc

SEQ ID NO: 13173 - DNA, 1500 bp, Zea mays
cagtcaatcatctatgcaaatgttctaaccccttaagtgtgtgatccattaggttcacatgtttacgactatgattgaaaatcattttcaagccattagtgaatagcggcgcctagcagcacatattgtattgcatgtacacataaaagatcatatcagttgaaccttttgccatacgatatccatcaaacttaaggcgagatttgtgccacccttgtaatagctcaacatttcactcgatcttgtagtggattacaacttatgactaactctttattcacatcatgattaactctttaatcgcattggtgttgggtgtttgcctttatcgaaggtcctaaaaaataaacaatggctatctttgagttcgtttcatgaataataaggtgagcttcatctcggtaacacccatgagtataagacaaaggtaatatttccgtccttgcagactaagcaaagcatgttgaagtgcccgatgttcgaagcatgtaaccaagggggcgaaggaagggtcaggaagcatatgcaacacatctccaaaaggaaaaatacaatgttgcccccagctcgttctaaactctgtgtatgcaaaacttgagagtgtgcatgtaaattcatatgaagttatacaccatattgctactataaatagaggtatagtgtccatgtataggaggttggatgcatgcactctttgcggaacctctccacatccgaagttgtgagacatacgtaccttcgaactatttgaagttatgaaggtacctttgtaattatgtataatgaaaggaaagttaataaaaagaatgggaatactttacttcattaattagcattcatgcttgtatgcttcattttattttacctaatgtccttttaaatggttcaccttcgtatcacaactagataaataagaaggaaccctattactttaattgtgttgtcctaatttggttctctctaagaatcttaatatgtgaccaacattggcgtccacttctgacgaatccacgacaaaaaagaaatccttcgccatgcatctgaagagaagtgcaactaccggttatgttcttgctcccatagatcataatcaggttgaagaaacacatctttttgaaggccataatctagaaaaagacaagaggaaggctacggaccctccaccacaagatgacctcgaccaagaaatccaaaaccttgaggctattcagcagcaagttgagaaatgaaaggaaaagatgctttggatctctcaattgcaacgacaaattgacaaaacaccagaagagttgcgccatacggaaaatcaaggcaagcaaaaagaagaaccatactaccgtaacctaagaaatctccaccacaaaggccacaaccatgacaccacatatgataacactcctcccttggcagcggacttgtaggccacaccatggccaacattgtatagaccacctcaactcccgatttaaagatggtctatcagatccaaagtagttcttg

SEQ ID NO: 13174 - DNA, 1470 bp, Zea mays
gtgattctaaattaatgggtcattaatccaaccatcttcctcgagaatatttttttgctttaagatagaaaagagcactatagttattgagtttagtaacctataactggttgttgtaataccttggtcttagtatactcatctattaagaaatagacattataagctaagaactaagaaaataaaaattagttttgagtataaacgagtaagcatgagatcaaggaggggaatattaagacgtgagatcaacataacagtagcaagttgtaacgtggtttaggccccactaaggccttgttaagttgcatagggttcaaagagaattgaacgtgactaaatcatcttttatttaattttgattaagaagggatttaatccccttctaaccgaacaagccctaaggtaggattgcgggtagctgtggctttgcctcctcggcggtcgttcttctttctccatttaaaataaactaagaaccggcaaaaccaatactccccgtcctaatttttatttcgtttgactagctcattttatttaaaaaatcataattattattagttttttctatggtattgtttagataagtatagttttgatttttttatttttcactaagactagtcgatcaaatttggtgaaaaaatcaaataaattataaattggaacatgggagtattctttttgttttattatttgttccacttcgtctacgactgtgcgtctgtgccagggagtcggagccatttgttgccgttctatacagggccgtagtaaatagtaatgaactaaacaaaccttgatcggctaaacacataatcaaaacagcagcgctgatgccgttaaagaaatggataaagggaatatagattaattgttttaataagatgtgcaagatagattataattgcattgttcgactacttaaaaaacagaaatatttatccaataaggacatgatgaattaatacagacaagaaaaaaaaagtaaccaaatcagaatttgatgacaaataaaggaccgatacccgggcaatattcagccagggaatctatacacaaacaacaataaaggacaccgacgggccattttactagcagtgaacaacaatctactttttggcaaactgcgccttgatcctctgcacggtggcggcgtcgatcctgaacgccttggcgaggacctcgtcggtgacggcgggggcggcgccgaagagcgagtcggcgacgcggacgaggccggggttctggctgctgaggccggcgaggccgacggcggggccggcgccgcagttgaactcgaagtggacgaggcccctggggaagacgaaggcgtcgccccggttgagcaccctggcgaagagcttgccgtcggtggcgaggaagccggcgtacatctggccctccacgacggtgagcacctcggtggcgcgcgggtgcgtgtgcggcgggttgacgccgcccggcgcg

SEQ ID NO: 13175 - DNA, 1500 bp, Zea mays
aactcaggatatcactatatcagcatcatcctagaagaattaagaatcatctctccaatccactagctgtagcttttagtcatgaaacaaaaagtgtaaagttcacttgccaaaagtcatctggtttcctaaataccaaccaaacagctatgagatacccaccgcacaacttcacaacttcaacatcccaaaccacaccaaaatttctgatttcctaaataccaaccaaacagctatgaggtacccaccgcacaacttcacaacttcaacatcccaaaccacaccaaaatttgctggaaagtagtccccattatgtttatcattggtatcttaaccaaggaaagttcaactccaacaaactcataataagctcggcatactcggctcaaactaacatgagccccacatttctcattgagtaaatttcacaaaacaaccacattcttatccgtgtcacaaaactacaacttctagtgccatttcagaaactaccaccactttgggcacctttctaaacaaacatgccacctctttgcctcctaggttatcatgaacacctgcggccactcatcagtatcacatttttaccactacttttgttaactcagttttgcactatgtgatgctgacgagtgagccaggcaatcataatattgtaggaagaaaatgtggtagattctgagaagggaggcaaagtggtagtggttctacaaaactgaccagaagttgtgtgaagattttaggacataaatgtggtagctcggtggaatttactctttcctttcccattctctgcaataatcacacccacgcgcacttctattttaaatagcacacaaatgcacaataaaatggtatatctgcacaataatcgcacaccccaagcgtgacagatgcatctcctagcccctcgagatgacttaccaaaagcagcaaaataatgctagttagcctagcaaagttctccacgccatcacaacgtgcatgcacataacgcagagcgatttaggcgaatccaacacctctctgaagtttagccactaaccagacatggaaactaaacgaccgtccataatcccgagctgaattaatcatatgcccatactgcggtatccttatacgcacagttatactcttgcagtcccaggtccctcatccaattaccgacgaaattcgcacgcagtgccggacggggaactcaaatcgcacgctcccgcgaatcaaattccttcgcccgcactccgcccactggcgcatgaatggccggcgcccaagtagacacataccttcgcggccacacaaaggcaatcgagctagcccgagcgaatcgcgggttagaaataccgggagaaactgtggggaggtcgcaggtagtcacctcgggcagcacgcgatccgatcagcgaagtagggggtgagcgagccaaccgtccgtcggaagaaatctgcggtgggtggcacctcgcctcgggaatcgcgagcgggggaggttagggggag

SEQ ID NO: 13176 - DNA, 116 bp, Zea mays
ctgcagcgcgatcgagcagccagaggccagagccagtttcacttcactatcactcaccagaggtacggtgggttttagtggtccaccggccgatcgatcataccataccataccat

SEQ ID NO: 13177 - DNA, 52 bp, Zea mays
tggcgcgggagaacgagagtagagggagcctatgagcaaagcctactcctag

SEQ ID NO: 13178 - DNA, 463 bp, Zea mays
gggcccgtttggcacagctccagctcctgattctaagcgaggatctggaggagccgtgccaaacgggtatttttttaaactgattctcgtgtggagccgaaagatcgggagtcgtttttgtgaagaaaggtgggatctaaaaaaacctgctccaccctcccttaaaacagctcctcaaccaaccaaatatggacctccccttaaagtttgatcgaaattacccgcaattgccattggacaaaaacataacgagccaatttatggattaaacatttaagaccattttatgcactactatgatgagaatattttatatgttattgtttcataatttttttccgtatatgcatcctacttattggtttgtaacaaagttgaattgcaaagggtaaaacagacaatcgccacagaccaccaactttcagaagacaagaatcagtttacttgccaaacagtgttaaaa

SEQ ID NO: 13179 - DNA, 1500 bp, Zea mays
ctccctaaatagggatgaaaatgattgatttctatatttatcatgctccattttatattatccgacgaataaaaaatgatacaaaaatgtgactacaaatacaaaattagaacaaaacaatttcttttgtatcctggttgttttcgcatatcccatattaagttcataatcccatatatatatgggacatcatgttttacagttgtgaaagggaaatgtgcccttgggccatttctataaatgttttggtgattagatgctcaacacatattgttttagttcatatgtactaagtgattgagaagtgcaaaatcaagaatcaaggtacgtgtctagacttagtaaattgcttttggatactaacatatctctctaagtgctaggaacattgtcaagaaaactggaatcggattggaggagttttggctgagttcagccaaaacagcaccagcccgtggcgcactagacagtgtccggtgcctaggctggcacggcgacgaactcgtcgctctcgggaaaaagcgaaggcgtcgtggctaaaaatcaccggactgtccggtgagccaacggcgcccgtggccaacggtcggcagcgcgatcaacgggcgacacgtggccgagccaacagtcacttggtcgcaccggactgtccagtgtgcaccggacagtgtccggtgcgccaaggggaccgagggcgcaacggtcggcttcaccagaaaaggaaggagatcaggcaccggacagggactgttcatgtccggtggtgcaccgaactgtccggtgtgccacccgacagaaggcaagaattgccttccaaatgaatctccaacgactcctagctgccttggggctataaaaaggacccctaggcgcatggagcacagcaccaagcattctctaaacatcctaagatgcctagacttttcaaccacgcaatcggatcatcgtatttgagattggagcacttcttgagttgtaaactccctgcgtcgtgtttgtgttctcacgtcttgacttgtgtgcgtgggattgctgcgattctagtcttgtgtgtgtttctttccctcccttactcttgtgcttttcttgtggacaactttgtaagggtgagaggctccaacttgtagagattcatcacaaacgcgaaaacaacaataaggaagaaaactgtggtattcaagttgatcgttggatcacttgaaagggattgagtgcaacccttgtccattgggacgccacaacgtagaagtaggcaagtgttatacttggccgaaccacgggataacacatcgtgtctcttgtgtcgcttttctctgttattgttttcgtcccaagagctctcactatagcaacttggtttaatctaactaatattttataaaccgagttttgtgctctttagtgttgaatttgcaggatcacctattcacccccctctaggtgctctcaattggtatcagactcgtactattaatttaaagggactaaccgcccgaagag

SEQ ID NO: 13180 - DNA, 918 bp, Zea mays
tggccgaagctatagcttccgggcaggtgctcaacggccgccgcgtcggaacggggtagggagagaggtagggcaaaggaatacttcgctaatcaaggccgctgtcctgcgcgggcgtaactgctgctaatcaaggccgggatgcggagcagttgcggcagtcggtagcagcaggccagcagccagcacagcgccttggagagttggagttggaagaagcgggtggtacgggaatgggatggtggactcgccggtccccgcctctccggcgcccggcggagagtccaacgaaagcatgtcgctggtaccttcctttgacttgggcctcgtgtttcaatgggctgtggctccattgggctgcgagcaggctgccatatgcccaggccgttatctcagatgggccgttgcacttgcacgtctcgctcaggcgctccttattagcggccgccaactcgccggcgctgcgtccgcgtgctgcgtcttcaccaagctcccggtcgccaccgcgcctctcgtgcgcgcggcggtccggcgtcgatgctaagcccttcccgctccatcgcttccgcctctctcgtgtaattctgagtaaggattcatccttccttgactcttctctgtcggcagtttattttatgttttatgggggctatggtggttcgggggggattttgaactgcacttagctgttcgaaggaagggccgaccgaatcaaaccgaaaccgcgtggattgatacaggccgatggtagctatctactttggcattcgataggaaatgggaatcagcagtgcatattgttccctgtgatttggatgagcagtcatcaatgcaggcggtctgtgttcatcctgtttgtaaacagcatcggagctcctgtgtgtaaggctgtaacatctctctcctgaaactggcaga

SEQ ID NO: 13181 - DNA, 918 bp, Zea mays
ttctgccagtttcaggagagagatgttacagccttacacacaggagctccgatgctgtttacaaacaggatgaacacagaccgcctgcattgatgactgctcatccaaatcacagggaacaatatgcactgctgattcccatttcctatcgaatgccaaagtagatagctaccatcggcctgtatcaatccacgcggtttcggtttgattcggtcggcccttccttcgaacagctaagtgcagttcaaaatcccccccgaaccaccatagcccccataaaacataaaataaactgccgacagagaagagtcaaggaaggatgaatccttactcagaattacacgagagaggcggaagcgatggagcgggaagggcttagcatcgacgccggaccgccgcgcgcacgagaggcgcggtggcgaccgggagcttggtgaagacgcagcacgcggacgcagcgccggcgagttggcggccgctaataaggagcgcctgagcgagacgtgcaagtgcaacggcccatctgagataacggcctgggcatatggcagcctgctcgcagcccaatggagccacagcccattgaaacacgaggcccaagtcaaaggaaggtaccagcgacatgctttcgttggactctccgccgggcgccggagaggcggggaccggcgagtccaccatcccattcccgtaccacccgcttcttccaactccaactctccaaggcgctgtgctggctgctggcctgctgctaccgactgccgcaactgctccgcatcccggccttgattagcagcagttacgcccgcgcaggacagcggccttgattagcgaagtattcctttgccctacctctctccctaccccgttccgacgcggcggccgttgagcacctgcccggaagctatagcttcggcc

SEQ ID NO: 13182 - DNA, 1500 bp, Zea mays
atgatggggccacctcgcgctcggattattttaatcgtttctcgacaacgagctcagggaaggtgtttttcggaccttcggcattccgaagcttagaacaatttttcacggatcaaactcgttgcgaaaaatgatctagcaccacgaaggggctactgttgggggtctgcttcgtagccgaaggtcctgtaagaagaaacaccttcggaagatcagcatggaaataatgtcgaagctaccttccagggaacttcggcataacgacatgcctaagacaaagggttgcaccgacttaaagatgaaaagacagattgacccatgatagtttgtgtcatgattgtaatcgattgtaaagggtataaatgtaatttcacacaggctgcgccctgtgcctataaatagatgaacagtacccacgtactgttcatgctgatttgtactcgctcgtgcatcacacttgttctttctccttctgtcaagccgaaggtacaaatgtaattctatattatctatgtttatccatgacaatataataaaagatgagttaataatattatgtgatcattcatattgtttcttatactttacatgcttcttctttcattatcatatactacaatgatgaaggttcgtccttgatgacctttgtctgaagatcattatatcctaagggaaataatgcttcgaaggacgaagggctttaacctttaacatttgtgttgccttgttcttaatttatagaatttgagaacaagtccccaacagtacccgcgggtattagtcatacccgcccgcaattgtacccgtaggcaaaaaattgtacccgtgcccgtcgggtatcgggcgagtatatatataagcaatacagaaaaaatccagaaaatataatcataaccaacaaaaattccaaaaaacttatgcgtacagggaacacttcaaacaagtcttcatgaattatgcgtcaacacaggcatacagaacataatatgggaacacttcaagtcttcatgatacatgctcactagttttttagtttttacggatatccacgggtaacccgcgggtgacaaaaaaatatccgtacccgacccgattttatcacgggtcgggtacgggaaagacccgcgggtacaaattcgtacccgaaaccgaaccgacgggtcggatatccgatggatatccgaacccgcgggtaaaattgccatccctaattttacccgtccatttaagaagtaatccttatcagggaaataactatacgcaaagataggaaggcaaggctcgacgtacgccgctgaacgggagagcagcacatctcggttgatttgaagatcgaacgcacggcaggctgyggtaaggcagcggatctggttccgtttagctagggttccgtctccctccaccagacctgctcaacgccttccacgggcgcacctcgacgtgycttgagctagggtttcctctgccgctacctccgttttacgcggccggcgcgcagcc

SEQ ID NO: 13183 - DNA, 531 bp, Zea mays
tgtatataatgtttcccaagttttttgggctcattaatttattgtgcaatatcaataggggcctcacagttctatgtcaatctatcactgcacttatgcacttctcttctaatactgttcttttcaattacatgcttgtctcaaccaaatatcatgaccatagaaacaaattcttatatctgtacttgttgagggtcccagtagtgtatggtgctactattatactttgaattgttgcctccacatttcttccattcagtgaattatctcttttgcacttcttttgaatgtagaacaaggtttaaaatagcggcctatagccttttggaggacctaaagctacgatatttcacttttagatgctattatagctacaaccgttatagcccgatttagctcttctaaatgtcatagctttagcgctaaatagccacactatttctatttttcagattccaggccatcccaccagttctgccacccaaatccatctcttcaccaccatccgatgtagcctcatcaatctctgct

SEQ ID NO: 13184 - DNA, 1127 bp, Zea mays
ccttttgatgctctagcgtgcaagtgtggctatagagactatgacacgtatcgaataatgaccttgagtatgcctgtaatgtatgttatggcaatagtacatctatcaaactagaaatatttacgtaatgtgtgtaagaccttatccaaagtgccagcattacaacaccgtttgagagtagacttcgaatgtaataacgtaccttcggggcaccctgccgacgatgatgtacgagagaaatgctgacgaataagacatggcctacaccaatatgggtgttaggacgttgtggatgttgcttattgagtaggtcgctgaagttttcaaggtccatatttcatatgtgatccatactgaataaagagtgggagactacgatatgaaggaagaatagtgaattggagagtgaatggtgcgaatgaattcaaaccccctatatttatagtgtaaatgcattatttagatttttaaactccaaacggtcaaaaygatgcaaacagcaacacagggtaacatacgatcaataccaccgatagattatctaatgcgtgagtcgataccgcccagtcgacaccactaagttgactttagcatgatcgttaccgacccaatcgattggtcaactaagctgactacattgaagtgaggggtatcggtacctactgaatccaccgcgtctacaatcgacatcgacgagtgcggagctggcctaaagaaacccttgaatctcattccgtttgcccaccccataaactgtagaactttgaagtcctcaagtacaaaaactacccccaaaccatattggcacccttgcataaaccaaatttacaaatatgtccctcatctctcgaagccgccgcctcctgccatcctgcgactgcgactgcgagtggccgttgctgctcccactcccacagttcgaccgcgccaccgtttcacccccttcctcctcctccgccaccacagtgccacgccactcctaaccctaattctcgggagcctaaccctagcctcaagatccgttcgcctcatgcctctcccttcccgccggcgccgcaggctgagctgagccggaccggcaattccagtcgacgggcgccgttgctgtcgcagttacaacccgcgcc

SEQ ID NO: 13185 - DNA, 83 bp, Zea mays
tgtagtcgccgcacgccgccggagtggccgccctcctgcggtcggtgcaccctgactggagcccggcggccatcaggtccgcc

SEQ ID NO: 13186 - DNA, 590 bp, Zea mays
cccatatttgtttatgttatacaaaagagatatattgtaaatatacatatataacaaattgtaaataaaaatatataatcatgtttaaattaatatatcatttaaataaggtatatatatatgatatatagaaatgtatattacaactaactagtatatttttatacaaatctgacgaagtattatactctttccgttcataaatatataatattgttgactttttaaaaaattctgactacaagacttattcaaaagaataatgagttactatttatttttttaatttgttttattatttaagatagtttgtgtttgtcttaaaattttatattgttaaataaaacgagtggttaaattttcgaaaaaagtatcatatacttatgaacggaggtcacaattgtaaaatcgcaggactggaaatagtttattgtgcacgtggctgcgtgctaaaccatcttccaggcaagcaaattctgcgcacctcctcccagtgatcccgttcctattctgctgttactttgtctccgcaggccccacattctccgtctcgccacggtcgcggtcgtggtctcgctccggcaaaccca

SEQ ID NO: 13187 - DNA, 770 bp, Zea mays
ctgcgaacctgacaagtgacaacggtacggtttcttcgtgcgtttcgtcgcggcagctccgtcggcatgcccccgtgtcgctcgcgctgttccacttccaaagcctgcgctccgagcgtgacgtcactcgcacggcgcggtggctcaccctgccgctgctgcaggctgctgatcgatcgaacgcctgctctggatttttgacatgtgtctacctgttaatgatcgatgtgttgtttttttatgatcggtatgtatgtgattgaagcagataaaaaagagcttaagctagtttgaaaaccacatttttccaagggttttcatttttctcaagtaaaattagttcaatttctttgagaaatttgaaattccacgtaaaaatggggttgttaaactagccctaagtcagtctacgcttttaacggcatctgcaatttaagatgtactagttggtaaacaccggcagccagcagcaggcctgctctgagctctggagtccatggtgaccagattctgaatcatgagttcatgacttaagtggccgttgcgactttgaggtgcgctggactggactggacttgctcgactgagggaatggagccgtgcatttgcgaggcgaaaatatcacatggtcgtggtctgcctctgaggggaacggagtttcccatcgctttgggactggaaaatatcgcgaatcctggggaaaaaaaatatttgtgtccacctccctctcacccgtcgcgcgcagagccaaaccaacgactacaccatcg

SEQ ID NO: 13188 - DNA, 377 bp, Zea mays
tggactagctcattcctcgaaccaaacaccctattaatcaccagatcagccctcagagtaaccaaagtacacctagcccatacaagcgacgggccgagatgggaggattatttttagagtaaacaagttgagttcagctttaaagctacttgcgcccacaaaactaccagaacgcccctgaccgaccccgctcctctatatatacgcgcagctcgtctcacttctcgcttgccagcccagccctcaagcaacacgacgcattgcactagctagaccttgggctcgcaaacctcacacacccttccgcttaacctgcagcccttcgatcatcatcagcactcagcagtagcataggcatcaaggtagagaccccgaca

SEQ ID NO: 13189 - DNA, 874 bp, Zea mays
agggaggaagttacttgccttgctctttctctcatcataggctttggtttgtttagggtggggctccttccggcaatgctgaatgtttagttagaagtagagaagattttgccaattacccatcatgttgagtttctcgtcgcaccttctgttcagttttgaggcactttgtcagacacaagaatatatatatacctggtcatcacggcttttgtcctgctattatcattttgatttcagttttgtgcactcggtacactgaagttggatgcaaagcttctgatttgattaggtttatattaaaagattttgttattaagatttgttttatgtaaattacatatttataattaagctttatacatacgaccgtcgttaatgagccgtgtattaagaagtttctaaataataagacataaaatttaggtacactctatgctatcaatatatagcttagttgtcctttatatttagaagagaactgtgaggttgtacacgcgacgcaaccaaacattcgtcaactagtgcatggtccttccacgcccacgttttattttacttccccatgcctcccactgccacgtgccaccctacgctgctgcgcgcgttcactgctccatttccgtcgatcggtagcgcgcgtgggcgtggcgctcgctccctcgccggcgtcccctcgcctatatatagtttccccgcccctattccgtctcccgaccactggccggccgggcggcaccgccatcggagtacgtacacacgtcctgctgtcccgcatgccaccggccgggggagaaaaccaacagccaagccaagcccacattgtttccgcagctaggtagaggggcaaaggaggagtatagcggagaggttg

SEQ ID NO: 13190 - DNA, 1500 bp, Zea mays
acctctgttaccttccatgttcttccacgctgttgcttctctttccatcttcttcgtcttcaccggcgatcaccagagcttttttgccgagggcatcacaaattggtattggagccttgtcgccatcttccttggttctcggatcacgcaagtgaaaagtcgcagttacggctcctaacaagccgtccgcgcaggcgcgtcacctggttgccgcgatagagaacgtagacaaacgtttaaccaaggttccaacaagggttggattctttggcggcaactctaataggctgtttggtttgaggaatgaactagtccatcatcttcttacttattatttttgttttgtttgtggaatagaataagttgatccatcactacctcattccttacagttattatagttagttagtactaatatgaggaatggggtcatcccaccaaatttgaggaatggacccatgatgcactactatattttggatgaagtgattcatcaaaccaaatacctcctaaaggaataagtctacatgaccctccgatctttagatgatggtctatttcacttcctcaccttcaaaatcagttatttaaccaccttaactttataaaaccagataaataaccgcttaaacagttttagtcgacggttttgataacatagcattagttttatccttttcaattatgtctttacctagtgatwaaattttatgcaattttacacaaaaatggtaattagagattatatctgccctatttttctcgtaatttttggggcaacagtttaattactaaaaagaacaaaagctacataaaaatagcttaatatttttgttcctgatttatttcttatcttctgagtctaaaattattactagagctaaaaacattcgtattaaactattaattttttgttgattttattaagcacgctaagtagtggttcttctaattactaactaaattaattttatatttttaaaaaatacctagcaaacagtaataaaataatctctaatttctaacagatctcataaactaatgtaaatattttcaaaattttctaagaactttaaatctaaaatgactacccaccctccaatcaagtcaaaggaattatgtatttatgttgagctcagccacacttggccgtgcagacacgtaacacgttgtctggcccaagcatgacaagcaaacaaccagacagcccatacctatcttgcgcgcgtgcatgcaagtagaggattttagaacaggtaatgggtttccatgccgtccaatgtagacccgttaatagttttggcccatcattgttgtaacatctaataaggcccaccactccgttccccttgtcagccacggcgacgtgacctagggttttcatcagcatagtatataaaattccgttctctcagtcctgtttccccgccgccgcctccaagcgccccagcgagccagctccggcgaagtcaatcctgcgctccgcaggcagcatcaagc

SEQ ID NO: 13191 - DNA, 668 bp, Zea mays
acgagccctaacccggcagcgtagagattggataagacgaccatttgaagaagtcaaaagtacgcagttggggggcgagggttgattgcagtttgcagttgcatccccaccaatctcctcttccgtcgctctccaagaacctttggtttgactgctcctgatttcttatcatttcctgcacaggcttacgagcgtgatctacgcttccatttacctccgtccctatcagcttcctcgcttccctatgcctacgagaaagagagaagcgtgggctaattcctctgtgtttcccagcttcctgttcaccatggactcgagggagtgcatcgtcccgtcaaacaatcctgctccaatcttttgacgtctcgctggggcctgtgccgctcccccgtaccccgccgttcctgcaccgtcaaaccgccagccaagagtccatttttttttcttatcaaaagtttgcgtttgatcggtttcgtttctaagagctgcgcgagatgtccttgttccggaaggggaggaaacgagaggctctgttcctgtcgcgattgttggaggacctcaccatagtttgaggcggtgaggtggaggcgatagagaagacgagacaagaagcagccgccaggagctgagctgaggccctgccgccgtcttgccccaactccaaggcg

SEQ ID NO: 13192 - DNA, 122 bp, Zea mays
tgtacattttggtaaaaaaaagttaaaaaaacaaaaaaaaaatcggtaacagggactgggcctcagctagtcagctacaataaagtaaacaaccaccaccaaagcttcttccagcttgcaca

SEQ ID NO: 13193 - DNA, 239 bp, Zea mays
agtatgatggtcgtgaattcgtcgagcatggcacaaagaagtgtgtcgtgactatatacattggatccagtccacaccatgtggaatggagtgtcactgttgctgggcacagattcaaagacacctgccaagtcatcgcccgcaaggcattgagggccctgtgtcaaatttatgaagaagaagtggccgacaccctgctcagattctttccgccctttcagagaaaccgtcccgtttgg

SEQ ID NO: 13194 - DNA, 1257 bp, Zea mays
ctttaattgtttcaagtccaaatatatgacattcaagttaggacaacattgtatattgtctagacaaagcatcaacaataacaatatccaatatctttccttttcttgtgtttgatgatatataaggaaaatattaaacaaatttagctcacttagcatgctatgattcagttcattttggctccaaatatgtttaagtgattcgtaatcagaatgaataacaagttctttaggcaataaattaaacaatgttgctacgcctccaacgaacaaacaagtgcatacaattatttattgtatatgaaataattaaggttatgttatcaagttctttctttgttaaagtcacatccttacattaaaaccatatgaaaatattaatcttataggtgatattttgatgaagtactcaaattccaccgttgcaaaccaaatatcaccctaaactaaactattctatatctagtgatacttatttagtattataaatattagtgcccttttatataagtttggtgaaacataaactattttgatttataacaactctaaatgcaatttgggataggaatatttgtttggttaccatctaagcaatcaccatggtcattcacttgcacaaaattagagcttctttagtttcagctaccaaaacattccttttggtcaactcatctcgttactgcttaattaaatcacatgccatggaacactattcacaaatcgtaacttgttcaactctcacttgagattttcgcatagtataaaataaaggtgagcgttgtcttttaggacttattcggttagggataaactgagagggatttgaggagattaagagtccatttggtagccttttaaaaaaatggattattactaaaaagcatctaaaagctagagctatttttatatttcggagaagaagtcacaaatagtagcttcacccgctctgtctcttacactttgatacatgaaaatgtctccggctatagaataaactgtttctcccaaacgatttgtgaaatggcttcaactctactaaaaaattgtttttagacaacccagagctgcttttagataagccacatccctaccaaaccgactataaatctctccttattaacttttgaatgaagagatttaatgctctctaatcctctccaaacccctccgcaaccgaacaagatcttattgttttttaggtacacatagagatgaactaataaatacctttactcatcaggcggtgtgacgcaa

SEQ ID NO: 13195 - DNA, 148 bp, Zea mays
aaatgtgcaagtggtacaaacattctgcacaatttacatatataatacaggttgtatcgatacaataaaaagtgtatacatctttctacatggttgccaaaatttcgccggtggggacaatgggggcggctgtccaagaacaactgct

SEQ ID NO: 13196 - DNA, 705 bp, Zea mays
tggcgtgccggggccgcggcagcacggctcagcactggaggagtggagaggaaggggaaggagagcgaggaggatcgctaatgcgcaggcatttgtatgcgggcaggaaaacggagaagatgcatatagagttggattccagatggtggtgttcggtgatgaacagctrcatgctttgactgtccacctactcttgcttcctactcactactactcaccagcaaaggatactagatctttcttttttttggtggtgaaacggacagtgtactacaaaaaaaactgttgtgttctgagatcttctaatccaataatacaacacgacctagaggaagccaagttagtccgtggcgtcggcatcctaaacgatcgaggcaccctggctggccaacaattagtcaggagggagtttgcagtgtgctttcgccgacttggtcgcgggagggctctataaacctgctagattagttgtgctttttatagtgaggctccgagatataaggaacgaacctccagtcgtgccgccgccagcgcagcacgcgtgtgcagagccactaaccgtcgcgtgtgacgagagatccctccaactcgatcctcgccgccggtcggccagccggcggcgcacgatgtacgttctctcggagcaacgacgcccctcctcctgctgctgctgctgctgcggcggcggcggtggccaccaccacc

SEQ ID NO: 13197 - DNA, 1013 bp, Zea mays
cggtcccaaagtttaatacagttctgacaatacagtgttgagtatactgttttgaggctaatctgtcaagcttagataccagtttgtcaagcttgttttagtccaaatttgtatttactgagctgtgtaaattgtgtacaatttgaatactgttttagttggtgtagaaattgtgtagaatttctagatagttttatgctgctcggtgtgagacgtgtaaattgtggcttatgtattttttatgcccagtaaatactatcagtaattctgaatcagttttataattgtgtaattataattgcgtaattgtcagttttatcatgttgaatttttgtgcggtagtcgtccttgctatcaatgccctcggttttgagtaatttttattatgaaattttgactttgacatttttgcgtaattgatagctaggctcatgtttggcctttgtgttctcctctttgattttgtgttacggtttggtatttaggcagccaaacatgagctatgtctctgcaacttataatacggtaaaccaaacatgtgccatgttgatcctagctaattggaccaaacaagcaaacacatattgcaattgttggttgcatcagcctgtacaggctacacacaacctgcatatagaattcaaccgagctgtgctcatcctgacaactaaacaacygctataagatttaggatgtagaaaataacatatcgaaaagactcgaccgattttgtattcactttgattttcgacggttttaattaaagtgtttattataaagcaggctgaccagatgtttgatagtctccggcaggttatagaggcgacaagctgaaaaaaaaactgaaataaacaggatcattaattaccagtttaccaccacctccaaagcccaaagccagagccaagtaataacaactctcgatctttcggaaaaaggtgaggcccaacacctctgcctcgcaccagtaccacaacgccacgacacgccggcgaggtggacgagcggcggcg

SEQ ID NO: 13198 - DNA, 308 bp, Zea mays
cccttacccatccagagaccttgttcagaaaaccctactcgtgcagggacctatcctcaaaaccacaccgcttaccctcctcgtcttggtgctccttcacctctcccctccccgccgctcgcgcctccgaagtccgaacccaattccaaacgcaaattacaccaaaccatccccgaatcatgtcaaaatttccccaatacgcgtccaaaccccacccgaccaccctcccccaaattcgtttcgaatcagattaccgacgcgaccacccatctgggctctggccgcctcgccccccgtcgctcccttcc

SEQ ID NO: 13199 - DNA, 1500 bp, Zea mays
agccgaccccggaggatttacgtctcgcccgagggccccctcaagcaacggacacaccttcggctcgcccgaggcccagccttcgccaagaagcaaccttggccaaatcgccacgacgaccgaccgtatcgcaggagcatttaatgcaaggatggcctgacaccttatcctgacgcgcgcccttcagtcgacagagccgaagtgaccgcagtcacttcgccgctccactgaccggcctgacaagaggacagcgccgcctgcgccgctccgattgctgtgccactcgacagagtgaggctgacagcagccaagtccggcttcgggcgctattggaagctccgcctcgcccgaccccagggctcggactcggcctcggccctagaagacgacgaattccgcctcgcccgaccccagggctcggactcggcctcggccccggaagacgacgaactccgcctcgcccaaccccagggctcagactcggcctcggccccggaagacgatgaactccgcctcgcccgaccccagggctcgaactcggcctcggccctggaagacgacgaactctgcctcgcccgaccccagggctcggactcggccacggccccggaagacgacgaactccgcctcgcccgaccccagggctcggccctggcctcagccgacggtctccgcctcgcccgacccaggggctcggactcgacctcgacctcagaagacagactcgacttcgacctcggaggagcctccgcctcgcccgacctagggctcggaccgaccacgtcgcaggaggggccatcattgccctacccctagctagctctggctacggggaacaagaccggcgtcccatctggctcgccctggcaaagcaaataatgatggcgccccgcgtgctccatgacgacagcggctctcagcccccttacggaagcaaggagacgtcagcaaggactcgacagccccgacagatgtccttccgccaggctccagcgctcctccgacggccacgacatctcatgaacagggtgccaaaacctctccggctgccacgacggcatgtatttagggcactagctcctctctgctagacacgttagcacaccgctacatctcccattgtacacctggaccctctccttacgcctataaaaggaaggtccagggccctcttacagagggttggccgcgcggggaggacaggacggcgcgtgcaggcctctcgctccctcccatgcggacgcttgtaaccccctactgcaagcgcacccgacctgggcacgggacaaacacgaaggccgcaggtttccccttttacgcctgactccctccggttttcccccccttcgcgctccgtctcgcgccgacccatctgggctggggcacgcggcgacaatttactcgtcggtccagggaccccccggggtcgaaacgccgacagttggcgcgccaggtaggggcctgctgcgtgttgacgaacagcttcccgtcaagctccag

SEQ ID NO: 13200 - DNA, 561 bp, Zea mays
tttttccctgttgtatgtgtagtttatcccttccccccacggttgtaggtcagtaggtgtagcaatgatcatccttttgcttttgcgtagctttcatgtcatgactgggtacaccattttcttggagttcatatagttcagaacttcgcgaattgtgcttattaagacgtcggctaagtacgtttcatatgctctacactttcccgtctcaataattgcccccccccccccccccccggcatatgtatgttaattttatttctgacggactttgcactgtcattgttgactagctaggcattttgttttattttaggtttggcattagacggattccagtcaactccatccattttgatggttaaactatcaaagatactgccggtgctgtgaatggctgctcaagttcctcagattctttaaattctgagttcatcctcaactcggggctcttggtttaagccgtttggacgattcattgtactgcggaggattttttttatggctcatgttgcctcgtgacattgtggtctgaccaaaagctgcttttacatctgcttc

SEQ ID NO: 13201 - DNA, 1500 bp, Zea mays
gcgtgggcttcctcatttccttctgtttcactgggtgaaccgtcattttcaagacaagcttagccatcttagagatgtttgttagggtagctgctcacatgtttctgtgtaaaaccatttaatctttgctccccattgtttctgtgcagtcaggaagggggggaaaccttgcatgcatgtaaattttgaggaaatcatgtgctgttgtatattaggaatacctttgcatttgctggtgcctaatctttctgtctattaaccagagttatttggcaatgtatcatgaacatctttgtaggggttttttaggatttctctcttgtttgtggtgttgttttactttacactgtaatcttcattaaagaacttggtttcacttcgttattatactccaatttgaagagcttgaagcttagtccctacactgcagaactcaataggtctttagttttaggtcattcattcactataatgtttttaagatacaaggtcatgttacatctttgcgtgcacgttccttgtcgaccattatcattcgctatctatttttgaacgaacgcattcgctatctatggccacatctccacttcgtctttgccgaagcttcagtacgcggtgcgggtgtctcctggtgtgtatgctgttcttttctcggtccatattatcccccgtttgacgcgcctctgtcaatctgctgtactgtgaattttatttgacgtgcataaattattctggaaacgctcttggtacgtcacgtaccttgagaaggatggacacggatctggattgggaggcagtagcaccctaattctgacaagacaaaaggatggacacgaatctggattaagtgacagtggcaccctaactttgacaagacaactgctgatagagaaagattgaatgagtttgctgtgttgtttaaccacgactaggaagtaacacggagcatgcaactatattatattttcatgacatctccggtagtgcaaagtactgttttgaaatgtaaattttactttttgcagagtaaagtttaaaatagcgagtgagatagaccagagggtaagttttagtagtatggaaaataaaatattgtggagtattttaaggcagcctaaattgtgactattataaggcagtcgaaataggagtacctgatgagtctttttttttacctttggacacagtatataaatcggtaataaaatgtcgtggagtagtatttaaatagtataagactactttcttaatatgaatgaggccaaacctttcacatttttggcctgactggatcgtacatcagtagatgggtttgagtaaaaacgaaggaaggaagcaaagtatccttccactcctcgttttgattcctgggaagcatgaagcatccattcttgaccactctaggtatcatcgctgcaagcgaacgtcctactatatagatccctcatccaaactcaactcgcacatgagcacgagagcagagcgcgtccggccgtttcc

SEQ ID NO: 13202 - DNA, 1500 bp, Zea mays
catatcacgcgccctggacaccaagagctcaacgactagttgatgagcggatcgtttgatccaattcatggtcagatattcggatcctatgcatccatagcgttctgcatcgtctctgtgagaacttgggtgaattcatccggccatactccgatgatgaagggtttgatatgcgatcggatattccagtccaagtaccactcttagtatggttaaagaactataaaacttatacattagtgtttggtttgaagagccaacctatacttcataaggtgatatatcataagctcattccataaattttagtgaaatcaaccaatccgtcatgtatatactaattattaacttatgaggaatgaagtggtgatgaatcaactcattttatttaacaaaccaaacaaaaaagtgagaagcgggaagaagatggatcacctcattgctcaaaccaaacaccccataagtgtccttcatcttcttatgacacttggttctagaaagttccctttatcttcatattcaagttcttgcctcatattttacctgcaattgagaggtcttatttcatatcgattgtcataacttaacattataaagttatcctttaaaacaaaatattagttacaacattacgactgccatttacacgtgcttacctatacaatacatagggcctagctaaatgtttcattactaggacatctaatgttcatgtggccatagttttgtgatgtcttggtcatgtctaatggcgggtgcattgggttctaatttaggtatcaccgttgccttggagcagtttatgtaacgaaggatagagatcataacataggacaaacaaccgacgatcctcttaacttgaagctgctatgcgtgttgctgctgatggtgtatcctgccggccccttcctatgtgcctgatgagggcaaaagtagcctttgcttccgcagttgcacctgccaggtttacattccatatgtgtgctcagcagcagattgtcgtaccatgcacttccaccaacaggcaacagctacatccggtgtagcagcttctgcgtgataggtatcctccaaggtcactgtgcactgcaacatgaggcagagtgccctgaaccaaatggtggtgatcaggtgtgcatgtggcgtttcatatgtgtacatcagagtcaggcttattaggtgccgtagcatccaatcacctaattccgtgtatacaaatttagctctactatgtgttgtatatttttggatggcgtgtgataccgtatttaataccaaaatcgaagttgcatattttttttgaacgatgttcagttaacttcttgtcattgttctcttcttcaagttcaacaaacagacttcccaggaacagaacagctctgctctctcgctctcttttcggtcgctttttgaaaagcccttggccgccggcgtcctccgttctttcatcaattggggtttttgatggccagacgatcgggttcaggctgtttgaggaca

SEQ ID NO: 13203 - DNA, 299 bp, Zea mays
tgtaagattccccacattctgagcagttaagcaacttttttaatccggtaaatgatgtgatgtccaaatcaccaaaatctacaccgtacaaagaagtaggaagttgattggtctaagaagaaaatgaaattgctccctaatgttgctggatccagttgcaaacttcctacagtaatgtttcatttgatgtccagctgacagtgttatatttgtcagttactattgtttagtcagtaggtaatgccgcccgcttttccatgtgttcacccataggattttgtcccatttctccagttcca

SEQ ID NO: 13204 - DNA, 200 bp, Zea mays
gagtagttatacacacatgcacatacatgtcatcacatatacctcactgtttttctagattaaattaaaactgcaaatgcctaaatttctaataataaaaaaatctgatattagacatttttctgttagtggtttttgctgctgcgttaaaaccaagtgaaccatttgatgggacattttgtaagagatggcgtagtaag

SEQ ID NO: 13205 - DNA, 1117 bp, Zea mays
catgtcccggtacggtgtccccgtagcctggacaaggacaacgtcaccgtaggtactatgcatggtaaaatcagggcgagtacggcgtgaatgaatcaatgtcgacaaacagctatagctagcgcgtgtgtccgagaagtttagccgagccctgaattcgtgggctggtgattggtgtggtcgatgcatgattgaccgctctaggacttacggtaccctccgacctcgcgtagcactagcactagcacagaagtagtgcaagccaacgttgttactcatgtgacctgctgctttctctatactgttaatccatgtgaccttggtacttaccactgtctccagctgctgcatctcgtgtgatggattggtcctctaatcctcttcacgggcataaccggtctggttctcagttccttgtagtattgcacagtacgtgcaggcagctggcagtggcacctcattaatcctggtgctaattgtcctagtcgcgccattaatctcccagctgagactaacaccaccatattcaccgtaccatctctgacctttcttgcagttgcagctagctcctccacggttctttttctgagctctgctagtctgctaccctacccaacacggcgcggcgtagggcgtagcacataaaaagaacgcagcttttggccacatttgatgcccatgagtcactgttggcgctgccgatttgccgaagccacggctagtagctcctccacctacatgcatccactgttcgtcttcgtcgcctcaaaccttatccttccccccggcccgtatactcagcccaccactagggagagaaagaaacatacgcatgccaccaacgcaaggacctcagatcctcagatacgcatcagttggcaccagcggcaaagctgcggcggcgaagagcgataagtagtagaccggggggcggtgcggcgtgcagcgcgctaataggcgaaccccgcacgcagacgcaggcgcagctagcttcgcaacaagtaaacgatacctcgcgtcgccaagagcttaccgacaccgagaagcagccacgcgctcgcggagctagagctagagcctagagctagagcgcgagagcgaccgtcggccactcgcc

SEQ ID NO: 13206 - DNA, 625 bp, Zea mays
tcttgattgtttaacaagaataataattcaggttcccatggacctcgcatcatgatttgctgaaatatttcctcgtggtgcagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttaatgcttgttggttggaatgtagaaataggtatctgaggaaacatatcaaacactgctaggcactactatgacatctcagcgcattcaggcactatatgtaatgctatgtgtttgacaggtcttgttcttattatgtacttggtgtgtgggccaaagcatcgtttttggcgttctcttttcgtcttgattgatgacgtcccctttgctaaatcaatttgaagtcaggtctcaagtgctaatcaaggagggtaacagctttggacagctcgaatgtccagaggagacttgggaagaggttgctgaaaaagttcacaaagaccaatggcttaaattcaatggcacaatgatttatattatatggaacctttgaaggatcaattactaaattcaacggcaca

SEQ ID NO: 13207 - DNA, 1500 bp, Zea mays
attctcgcagcagtgcagggacaaaatatgggcacaatagagcttgcaactttactcatcttcgttcagagtagaattgagcagcaagtttgttcaagatgaggaactatgagtattacagccttttccttctcaaaagcaaatgaataaaaaaaacatagcatggcattgcaaacagtacaactaatagagcttattatcgacgaactctgcgtcaccggaagcgagcccgcgggcgatctgatccccttcgcggcctcgtcaacgacgccgggtcgtgtgccttccgaatcctcgtcgaatccgagctcccggaggcacccgaggcgcgggctccccaaccgcctctcgaccccgcgcgcctgcgctgcgcaccggtgagctcgattcgcggcgccggcgtcgcctctatttcatttccatttcccgttcgcttcgtcgttcctccggcgagagagggagcgaggtgcatgttcgaatcccctgccattttcacctttttttcccccgggcacatcagatcgcgaggcgcgctgtagcaggcgatgcttgctgcgtgctgcctgcacgttccttttattcggcggcgccagtgccaaagcagcatgccgctgacgttctggtggtctcactgttcggcctcagcgtgtgcgcgacgctgaagaacggcaggtaccgcgggggtgtgatgctgtcattggctgtctgctccattcgcgctgccgtgaggttctcgtartttcagtggttgtttttgggtaatactgtcgcgttgtgcgtgcgtatgtgctggattggggccctgcgtctctgcgggaaattttggtgccgaatgttctcttgtgatccgagtcattgattacgaggtaaaccgtgcatgtgagtccttttgttttggccaattagatcaccaattcaaactcggggggctgaccaggataccgtagctagctctagctttttgtctttgcataggtagcccaaatttagcgtgtagcgccgcttgctttggctgttcatgttcctgtgtgcctctgcatgtttttattccataacggcgagttcaaattttggtatcatttgcggttctactgtgtctctgttttcctaaatgctaattgatcggtttcatgttatgcttacatgtttgtcggatgataccaacaagtgttttcatctgcaagtgaatgcatgtttttttttctttctgaacaaacgtgattgctcaggatatctttgatgaaatgattggatattctttttatgtacaacttggcaccaactttatgcaaaatatataccacagcacagtttcttgctgaacatatgagaaccttttttcaccatgtccagaaaataatgcagattggggcatggagcttagctgtttcactttgcctaaataaagtaatatatcatatctcatctaaatttcattcccttttctgttttttttcttcccaacagcgacgaaaacaaagaactactgatcaatataaa

SEQ ID NO: 13208 - DNA, 1500 bp, Zea mays
actaaagtttgcctaacataaagaaattatcaatactatatttaacaaagtggttaccgagtaaatcaccggttaggagtatttgttacaaagctatttgaattaagtttgctaaggcgctaagctatgaaaataaacagtaaaggttcttctatattctaagttctgtctgtttttacgcaactgtggctttgaactgattcttgtgtacatccattggttctttcaggcagtggcggcaattaccgtccatagacatttcaaatcgcagctagacccggtatgcagtattagctctatttctccatgttcaacaagtagttgcacttcccttttttctctgtgatctcacgtccatcagtgagtacaactgcatgttaacttattggataagtagagtttggttagatggatacggagtttgtttagatagataaggatttggtttgttaagatactccctccgttcttttttatttctcgcgttttagttaaaaaatgaactagcgagcgacaaatattcgagaacggaggtagtagtaaaaatcgtatacgccttgaaaggaaagagcgaataatgatttagacccggggtacaagttagtaaatgaaatagctccacgcattgtttcgaagactacatttcgctatattggagagtgcacatatgcgcttccttctctttgccttgtcatcaaaaggctgacatggcaccgcctaatgagaaataaactctctccactaaatgtggaataataacatgaaagaaaatggaattgcatgttcatttataacgaaatttgaactttatcggcccctcatgtccaggacaaagcactcgcaggcctggagcttagaagttggcacggcagagtcgttgccaacactggcctcgccacgggtgagtcggccggcgtgccactaccactgccacccccggttggtgccaatgcaaaatgccaaacgcgacggaggctcagctcaacccgcggcgagatggcttttgggtgggcgtggtgagatagatgcatttggtacggggatctctcgctcttctgtcgcttgctgtttgacccgactctggagtctggaattcagtccggagtcgcttgtgagatgagatgacgcttggcgcaaggagttgtctggggaaatcaccaaacggacctctcagatgccacgccacggacgagtcggccggcgtgattcctccctccccagcccccagacaagcagcaagcgatacaatagccggagatggtatttgttcattcatgaaaaaaaagggggggtcttcccaatcccatgtggggtcgagagatcaggtgacagaaatttcttaactaccgtgcgatcctgaaacaaaatacaataatcagcacgagggcctgaaggagcaagcagtctcggtctttatcttgtgccctggcttcctataaagctgaagcatctcgcgcggtctctgtcctgcctcgaggagcaagcaagtcgaagcatcaa

SEQ ID NO: 13209 - DNA, 1500 bp, Zea mays
ggcaaaccataaaaaaaatgtaatatcgagtgggcaactttgcttgggaaaatatgaaaacttattgatgtcgcaatagaaatgtcccaatcgtattgtaataaatctatttatgcaaggagggggtttaattttgccacgtttggcattccatggtaatcaagggaatacggtcacatttaaatacctttttttagaatacattagagtgtctttttgtttcaagtgagactctgtttgtttactctctagattacataatctatcttaaataagttgataggtaaataaaaaatatagattattaggtggattatacaatctagatgtatagattatgataatctataagtaggtcattaggtgcttatataatctataagatgcactatataatcctgaaaataaacaaacaacgtctggatttagaatccttgctctcttagacttagaattattgccatttcacacggattgcatagactaatcttgtaaagtttatgcgctccaaacaatgaactactagagccagagctagaggacaggattagcgatcaagactacaactactcctgctacctgatcgctgccgccttcaatacttctatcttgtatttatttctatccgtgaagatgaagaatcttgagctgattgatggctgaaatcaattggaccggccggcgaagaagagattaggagcggtcccctccagctgaaacgataacgacgtagcataatggcccgctgcttctagatggcgacctcgtgccaaacatcatcataagttggccgacgtcgatcactttgcacggactcgctttcttttgctgtgtttggtttgtagagtcactttatactttataaggtgatgtatcataagtttatttcatttattttagtagaatcaactcactcctcatatatatgctaattattagcttataaggaatggggtggcgatggatcaacctattctattacacaaaccaaataaaaaagtgaagagtaagaagaagatggatcacttcattcctcaaaccaaacacactctttatttctttcattcacagggagcctcaaatcaagtgttaatccacagcggatttagagacaccaaggggacttcttgtgtttctttatcaactcctaatgcaaatgccaacatacacacaaacacacacaaatcgaatgaaaagaatggtagtgcaagtgtacaatcttaagtctttgcttgattagtcatgatgtgatgtgtgaacatattctgacttctgagaaatctccatcgccgtatctaatcatagctacgtaagtactttgtttgatacgtattaaaaaaaatgtactcgttcaaaatccagatagctatatagtcaagaaccagtttaagaaggcactatataatagtcagtctgccacatcccaaaacgcaacacacaagctaaaataaagcaagcaccagaactcttttttccccaaactcgcaagtcgcaacggcc

SEQ ID NO: 13210 - DNA, 381 bp, Zea mays
cgtatttctcgacatttcccgttcccgttgatcgaaaggagagaagggtgaaaaatctcggcacaagtgtcagtcgttcactacctggcagtccgtagtcggtccacttcacctatcactatcagcttgcgaggagaggaacaagggcgtcttctccaatcctcggctgtattgccaatggctttccgcgcaatacttgcctgactcgacgatgcgttgttgccatttcttgatgtttcgtccgcttcgcctcttcgcgcttgtcatggggtattaaaggtctggaggggttgaaggcttccgctaatgcggtgggtatccaccgactgagcagtgggtgggggatatcgagcggttcttgttcctgcaagaaagggggcc

SEQ ID NO: 13211 - DNA, 58 bp, Zea mays
ggtaatccgaactgttaggacaaatttaatattttaaaatagatacgtataaaatttg

SEQ ID NO: 13212 - DNA, 1500 bp, Zea mays
ccacagggcgcgaggggcccgggccttacactttcacgcgaggggcccgggccttacactttcaggtgtcccaggacacgagggatccttggggcttatactgtcaggtgcccgggaggccgggacgcaaggggcctcaagggcttataccataaggtggcccaggacgtgaagggccttgggagcttgtatcgttaggcgccccagggcgcgatactgtcacgtgttccagggcacgagggcctccgggggcttatgcctgtatgccatggtatatggtcctgaaaacttagtttagaatgcatccttgtataaacttactttgagagttgtggcccttcattgaccggggcggccataggccccaggagcagtgtcccctcgtctggggacttggaagtcagtcacctgcctaaggatctttgagtgtgtcttggcagcagcctgtggtaatgccttttctcgggcgctgacagatatggtcgtgtgttaggctaccagtctggctttcttaccttggtagtcactacttttgtgtttttgtaagttagaaaagatgcgcctgtgggaagttacttttagggctagtttgggaactccatttttccaagagattcctattttcytaaggaaaaatgaactaatttcgcttgaaaaaatggaaatcccttgggaaaatggggagtttgggaaccctaatttttctaaggtcatgtttgtttcctttcattttgaggaattggaataggctatttttttagaatgtggcattccaccactttctaaagttatcatataagcctatatcaaattcatgggatgagagatgtaaattgattctatagatttacatgttatttttccgatgtacaacttatagcatactcttctacttgcttcactataccataaatatagtatataactacctctcatatgatttaagataatatacaaatatattacatatataaatatatgaatttaattaattttatctaaattataattattaaaatggaattcaattccaatgaaacaaacgggcttgtagagacccgcttcaactaagataactcacacggtgacccaacatttcgttctctgtttgttggatgcactgatgcatcaatttaagtggtggtggtggatcacgcgcctcgcctgatcaactgagccttatttgcacagagatttcacaggctctcccatcgtcggttggtgcgcgcggcgcgtctggcgtgcagcggcggcacgacacgcaactagcgcgaggagggcgcggcagcagccgctccagtcgacttctccgacgtggtctcctcccacccatacacccatcccttcccctcccacacaggcacacacacacccacagcacccaattccctcgcgctccccctctcccgcatcacacatcccaccgccgccgccaccaccaccacccgccctatacccgtatataattactcgtacccggacgccaccgccgcctgcgcc

SEQ ID NO: 13213 - DNA, 1288 bp, Zea mays
ggtggagtgtcgacttcgtcggctaaggttagaagaagaggtaggtgcaggcccaatgaatgagtggctcagcaacatgaaacatatcgtgtgtaggagttggtgatgacggggtgggcattgcccaagggtgggtgggctaggaacatttttatgtcaaatatagtacttcaaaaatctgttagtgataatctaataatatttatttggtaatatagatacatgtatttttatatagacttacacaaaacttgaatgtcattgccttttaaatacgaagtatacaaactatgatgatttaatcttacaagtgctggtgtcagtagcaattttcattatggatggtcaacctaatggtgagcaagatgcaaggttgrgtggctaaggccatatttggtggttaaggccatgttcgaaacatctagagccaatagttagctactaaaaattagttgttggattctaaacaccttcagttaataacgtagctaattgttagctaccttttaactaacaattagttcattagctgactcaacccagctaataatttattagttgactaactattaactttagggatttccaaatagaacctaactaacaaggtggccactagcaatgtaatcctacagatatcaccttgtactagcggctatatgtatatcctgccctacgaagactttctatttggctgtcaagtgtcaaatgtactctccacgagtcattaagcaaacaagactcggatcggatccacatctgacatctctgacaaactcaacatgcatgtgagagacgagagaggaatgacagccaaagtgtactatgcaatttaataaatgccgtttgacatgtataggccctttgttaagtaaagtaaaccaagctacctcaggtctactggttaactgagatttctttctggtgatgaatggggtgatcatctcggtgaccactagcggtgtggacacggcgggttgggccaggccaccggtgtcagtgaaccgagagcccctcagatctgagcaccactgaccggcgacccatcaccgcggcggttgacccccaaccccccgtctcccactctcccgcctccctataactagtctcctttccactccccgcctcgcgagaccacacgcgacggctgcctccaccacgccgatggcgaccgctcactcacccagctgaacaactccgccgagcacgcgcaagcagcaggagcgatagagatagaggaaggcgacgaggagctcggtccgagctactagctgcggctgcggcgacc

SEQ ID NO: 13214 - DNA, 776 bp, Zea mays
atgtctcgttcctggatggatgctgcggcgtccaaactgaccttgtacatatgtgatgttgcttccccccaaaccgagcgtagggaaactcatcaatccacctgccaattttgacgtgttcagtcagtgttcgtcatgcatccatccactctttattcttgggtggcaaagcctccccttcatccaaaatacaaatgcacacaaaacaaataaccacagaaaacacaactgtacaaaaggctaaagatacaacattccgatttttcagctgcagcaatgccagcaaagagaggccaagcagggttctcaaaatgcaggaactacataggtacacagtggatagctgtacagtaacgaactaaggatcaacggttagaatcagcaatggcgtcaaaacgatcaccatgcaacagcttgaacaccgatcacttcttaagcttgagctgttcgtccagagcatcagcgagtacttcttaaacatgacctgatctacagtttccaccccaaccgttcgtggttacgtttcacatactatcactccactgctcccgatgtcgaggactcgaggtccaggtccatgtcgtcgtcaaggacgtcgtcgatgcacagaaactgggtcgtccagcgggcgccatcggccggcactgttgtctccgccatgctctccgactcctcgtagttcactgtgccgtcgcccatgaggtcagctgggaggttcctgacgaaccaaggatgactctttatctcaggcatcgtcgtgattctctgcaaagagc

SEQ ID NO: 13215 - DNA, 54 bp, Zea mays
agaatcaagggcttctactccgactacctcttccagagctggctctgtgccaac

SEQ ID NO: 13216 - DNA, 1500 bp, Zea mays
cagtggccatggaccccatggtcctagtgctactgcatgcaacagtggcgcgtcctcctgtcctgaccgcagtccagttcgacacgggcgccgtctgccatgggtgtctatctgccggcagccttgtgtgctcgatcgactcgcatcctgtatcaggcagggaggcagaggcaggcagcccggcacaggagtgtacctttgcctcttctgggattcggggtatcagagaatgggagggtacattggtcgggagagtcacgagctgcctagcctactgtactctttattttatttactcgccagaattaccgcaaggcattattgtgtttccggtgatggtttgtgatagttttttttttcgcaacagtggcggcgctcccactcgcagcggtggcggcgaccgcaggcaaggagggctcaagctgcggcagtgccctacggcaaaggcgagggagagcacgtgctgcatttcccactgctcttcactctcctttccagctctcccgcaacaccaagaagcaacagccagcgacaatcagcaatggccatgtctcagcaagagaaccgaatatgcatgctctcttatcttcttactactgttagctaaggtcccgtcgttctattcctgtgttgataatatatgtttgtaaggttgtctccaccaacgtgctctaaatttcatcagctaaagtatattatttctactttacaacacactctaaaatatcccgtccacagtatgtacatatagattagtagtatagatggccaataagcacgaggcccgcgagcccggcacgaaggcccgttgtttgggcctggtccgagcccggcccgtcccggttctatgcggacctgggctgggccggcacgaataagcgggtcgggctcggacagaaaactaggcacggtgggctagcccggtacggccgtttacctttaagcccgttaaacctatattttttgcattaaaccgtacttactgaatcatttagtccgtttttggcctactttttttgtgcttactgagccaggccggtcgggccggtccgtttaaacccgctgcgggctaaacctaaaacagaccgagtttcatcgggccgggccgggtgggtcgtttggccatctggacgacccattctgtttgtctagagtaaaacggtgacctgtgctgaccggccatgacctccattgaccgcgacccatcatcacgggctcacggcagcactaaacatccagcggtttagcagccagcagccatggtcaaaccagaggccctgtcgccgtacgtggcgtataaaagctcgcgtatggccccgcctcttcgcgacttcgcctcacaagccacaagctagcgatccaaaaatatttctcgcgcaatcgaagtgagttcatagagccatattcagaaccctcaacgcaggcgttcgcttttggatttgatctggaagcacagcctcgctcaaggcaagaaagacggtgttacgtactgttgccgcc

SEQ ID NO: 13217 - DNA, 795 bp, Zea mays
ctgcagcgtgtactttactgggtatctaactgcacactggtagggtcttctttacataccctcgctgcgggtagcctcatgttttgacaatatgattgcccaacatgttcttccattctattccccatttttcatgttttctagacgtttttcttttaatgtggtatagttcttgccatttcacctggtagagcggtgccactattttacttctgtgttatgcaacgctcatttttgtaatataggagattggcccttctgacttaaatccaatgtttcatccattgcaaaaggcattgcttccttatgaaaaaaatgccggtattagttggcagggagggagggaggagcatctgattgcgaagttaatttctgagcgcaccttccatgcctatgatataatgagctcaggctctgccgctcagctatatataaaagtaattttgtgacactgatgcagcggtcattttggtaatatagcagattggcgtttttttttacttaaataccatgtttcatccattgcaaaaggcactgggaaaaaatgtcgggtattacttgggagggactagggagggtggagcgtcccattgcaaagttaatttctgagtgcaccttccatgcctatgatatataagttcaggtgctgctgctcagctaaataattttttaactgtatttttataacgcttgttctgctggttctgcaaaaacggttggtttggtcgtaattttcgctatctgactttgcagatagattgtatataaggaccacggttcagattactgtcaagc

SEQ ID NO: 13218 - DNA, 436 bp, Zea mays
cggatacggatagtattagatgttttatggttttttcgaatacgaatatagaatcggacagagaaaagtactataaatcgaattcgaatatatttgtattgaaatcaaatacaaatacggatatgtatattaacagttttgcgaatactgataattcggaactgcatacatgcatttccagtctagggaagccctcgcgtgatgtttatcgcacgacactgtctacctgtttgcaaaacggcaagactgcgcagtccgcaccgtgttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgcc

SEQ ID NO: 13219 - DNA, 692 bp, Zea mays
ggctggcaggtgtttcgtaaagcaagggatactgggattttgtctttcttcatttcttcaatagcaagctcatgcgacaggtacgaggcaccgtcggtggtgaggtgacaggtgagaggtcaaggtttccagaacaaactagtacttactagttccttgtgtaagtaaacactgacgatggcgacccattggcaaacagtagtaaactagtactcatcattcatgtactcctgtaacagcagttggagtggggtggggtgggggagctcggtctccgcctcgctttctgcagcaatgcgcgttgacccggcaactttttattcactcgcgtcaaccgtcaacggcggttcgggagcagcaagcaatctaatctcgccatttacaaacttttttgtccgaagcagaggatgtcctagtcaatgtcaaacacagcttgtcctcacgcactccctagctgttctaccattctcccggcacctgacctcacctccgcgtccaccatccttgtcaaaacggacctgagcagggcagagcagctcatgctcttggaactcccgtccttgttgagatcagtggatgaagaggtagaggagaaatcgagagaacccttacaagtttcttgctgccgctcacgaattcctgctctgttctgctcttgcaggtaagcctgctgcctgcctgccacaccatcc

SEQ ID NO: 13220 - DNA, 1287 bp, Zea mays
ctggtatcttaatctgcttattaggatacgtgggggaagaagttatattcttcaaaaagatttgagagcatacgattgaaaactggtacctccctgtcaacaatagcatttaaataatataattatgaagagttgggcacagaccggtgtaagcaaagttctactgaagcacacagatatacataagttattgcaaaacagaacagagtaccaatcagacagcaactttgaaggcaaagaaactaatatagtaaccattgaaatttctagattatcctaagcttatgtcgaaaacaaaatatgcgatcctaccatagtaccgccacagtttggaatgaataatgtctataaggcataccttaaatagaatatacagcataataccaacaaacaaacaaaaaaaaaacaagtttcaaagaaatgaccatggctgtcatttaattagcactcgggttaattaaaccgttgagcatatattttctttagtatttgataagctggtccaaacttatttccatcaacacatttttgtagcgtgttgtgaacgattgtctaaaccatagggtgagtcagaaaaagcaacaaaaaatcagtccaaattacttgtctgcatagagaactttgtgctgaaaatatgcattatcctctacttcgatgtcatctgaccctacctctgaaatagtaagctctcttacaacaaagctaggattcctcgattcatacagagcacacaattaatttatttcatycagtattacatctgacaagagctgcttcgagtgagattgaaaaacctgaaaatgtgcatgacaagactcccaaaaacccccaaaaacccaaatagcaaaactgaaaaaaaaacaatgaccaagtagactttcaagaacacataacaagactyccaatataagttcccgatcgttttcagcccaaagataaagagttgctgacttcatgtaagacgctctcggtaaaaagaaaaaaaaagaaaggaaaccatgtgattggcgttgaacttcttagacgtgcgccgttcaactcccatccccagcaacgccaccctatatatgttttcgcgccaaactggctcctatgttaggctaaccacccagagcaacgacgcacggacgtccatccatgcgtaccagcagagcctcaccgccggcgcggcggcgcggcgctatattataagaattgaagaacccaagtctttgagctggagtcgtccatcgcgacataccaacttaacctttcgtgacacagacagaccggccgccgccgtcgtca

SEQ ID NO: 13221 - DNA, 479 bp, Zea mays
taaagatatattcccttcatttgtaactttaagatattttagtcttttctagatgtataaattttggtacgcacttagatgtactatcaatatgtcgtttaggctcgtggcatttgtgcaagtgcccgtttaggctcgtggcatttgtgcaagtgcgtatgtttaattgcctgtgtgataggactagatacggcccttaaaaaatgtgatgtttcatgtttgaaaacgacgaaaaaagttgattcaagattagcctacgtttgaaaataacgacataacaggggtccctagcgaactttcacgcgcaactttccctgcaagaatggatcgcgagaccaagaacagtagaccaaagacaaaggaaggcgagggccaccatccccaaaacccgtaaaaaaacccgaattgacaaattgagtcgacggggaaggaaataaagaaggggaagagcacgcgccgtcgccagcaccgcgtccgcc

SEQ ID NO: 13222 - DNA, 975 bp, Zea mays
ggttagtaggaaagtttttattacagggagatatgcattagtttacttccagaataagagatatgcattagtttacttccagaataagttatttagttcctttttaagtggtcgcctcatactataaaggcagaccatagtttgtattagagatccatcgaggaataaagtctccctacagttgggcgggactatctcagtcatcgtggctcagcaagctgccagccgcagtcacaacatccgcccgcctagccacagttcctacccctgagatctgtccctggttctagttagctgtttaactgcttgcgcgcaagaatactagttttatatcctggtcccgatggactgttgggctgtgaagaaattaccagagccaattcactttattctttcttcatttgacgttgagttatggyaattaggatttgtattttgggccgaatggataggttaataattaagattttggttgtggcaactgacaagtaacaaaagactgcagccgggcactattcatcttacatgaaaatgcttcagattagtagctcgcttaatgtaagacttttatgccttatgccaaactgctcgcacaggttaagaaatctagctcagaataacctgatgcttgaccttggcttgagtctgcttgcctactttggagcaataacccgatcttgagaaatactagtgttgtgcaaaatttctcaacacctttaaagcctgagcactttgtagttggccttttttttttgctacactgttagtgacttgcaatgcgatcgatttcattggtaatgttcattgaatgattcctgatcagatggtaataacttgagtaccatcatcatgtagctagtgaaacttggcttctctgttgttacctgtaccataattccaactgattttttcctcatgtactcctttttgtgcatcctcgtccacatgcaggctgcagcaagcaactggacgatg

SEQ ID NO: 13223 - DNA, 260 bp, Zea mays
cgtgcgtcgcgccgttgcctggctccgtcctcgccgttcctctgtagaagctggccgctgacccccgccgtggtggccgtcgcgccgttttttattagatgaagaatgaatcaacccttgtagaagctaaagatagaagataacactactctgtttttgaatgtctgaagtgtaattttgcagccttgcaactataaaacaaacaatgtatggcttaattattgcagttgcacagtgtgaagatttaaaattgaagtgct

SEQ ID NO: 13224 - DNA, 381 bp, Zea mays
ggtatgaccatattctagtctgattcaatcacttaattcatatcagcttagcagcgaagcactgtgatagaccatatgaacttcagatgcagagcaggcacctcattatcattcatgtgcaattgttaccactatgttggaaaatttagcgagacttaggctagaagaactacttctctaggttgtagtacttagtcccatatgatgcttgcctatcttaggcagttaaaagagagcacacttttaaacagatttatctggggaattgatcagtcataatagtttgagcttgtattatgtctgcttatagcatggttaacctttcatttattcttactttttaaagagtttgtcttttcttgaatgttggtaaattcagat

SEQ ID NO: 13225 - DNA, 172 bp, Zea mays
ggtcagtacgcttgtacctctgtagtaaactaacaactatttaattcctgtctactagtttgcattatgacaatctgtactctttcttatagggatgttcgtaactggtgatttaagtcatcctaaatgaaaaggcaaactgaaagcacaacatatatgttttttttggcaa

SEQ ID NO: 13226 - DNA, 1500 bp, Zea mays
tccccgttgggaattgtacaaggaaagatcgaaggcacgcggagctagacaccaaccattgcaggtagcacctactggatagatgggtgtcttgcatgctatccatggcgagggatgggatcgtgatcatgcatttccattgtattcttaaaaacgcaccggcctacaaactagctagctcgcagattcactgaactactgtagggtgaaaaccctgcggcgtcgtcgagcgatttctcaacttggagaaatcggaacgcggtaggaagctacttgacgacagcgacgaacatgcatatgttcattttgcaattgaattgaaatttaattagccagcaagaaagaattatttccttcgtccaaagaattattggcgtgcttggcccccggccccgccgtgaatcatgcattgtctgtgcgatgtttttgattaagccgcgcaacctaactaggaagtaacattggcgggccggcgggcgggcagtatctagaagacctgctttatttccttgctgcgaaaacctagatatggcactgtcaaaatacaggtgaacacattgtttttttcaacaccggggcctgtgcgcaatcaatttttgctttattaagtgggcatgggatatttttcttccgaaaaaaaatgatttccagtcgctagcttgtggaggatatattatctgtggatttcgacacttgacctcactgattttgttcaggttccaaaccatcaagctaagtacgggttaggaccataatgaaccatatgcatcagcacaccttcttcaattgtcagtatgtcagatttgtcatgagtgtagtagctagggcaagatcttccgggggacatgtatgcggagcaagctctttagttcatagtacatgcagtatatattatatatcggggtgatttccgtcatcactacgtaccggggatacaacggtttttttactcgatctgtgtgctcgatctgtgcgtacagtttacctttcagtttccggcaaacttctgcaccgggggaaaaaaaaagaaaaggcacgcggcggcatgcaagatcagcagaattaaactagatcctgcagtgccctgtgcctgtgcgtgcatggtcaaaagagaaggatcgttgccgcatactttggccacactctaaagctagagccctccctccagtgtccagctagctaytagctcgagcagctcgcccgccagcccttgatcgttcatctaccggaccaccaaacctttttcgcaagctgcgttcctgtcgaccatgtaagaaaagcctaagaaaatggcggtggtagttgacacgctgctagcgttgctcgccacgccctatatatggagggggggactccggtggctgtccctcccaacacagcacacattattcttcctccacccatctcttgagtcgcctggccggccgccgtcttggttcccctctagagctcaacagcagagcagctgtgtagcatagagcgaggtttaaccatcagcgc

SEQ ID NO: 13227 - DNA, 1500 bp, Zea mays
taaaaccacactttcatatacttgataaagaacacaaagctagagataatgctagttagatgttttttgtagctttaaattagagtgtgtgatgtaattttacttttgttatgaacattagacaataaactgaacttacgaactttgtatagagctgattatactctttttccttctaacaaaatgatttataaaccgggtagtcattgcatagctgtggtaactttaatacaaatattaagtttgattttgttcaaatttatttgtcttatatgtgtttttttaatttagggctctaatgtgaattttgggccaaaactgaatttcgggccaaaaattgaatttcgggcttttataatttcgggtcgcccgaaatgagcccggcacgtttaaccaattacgggccagaccgtgggccgagggctaggcccatgggccgggccggcccggcccggcccgaaattcaaacgggccagaccgggccgaaattcaaacggaccggaccggcccgaaattcaaacaatacgggccttttcaggcttaggccgggccgggcggcccgaatatacgcctatacccaaacgtaaaaccattacaactcaaatccattagtaggtctacttgcgaagtctctcttgagcaagagcttagacggatcttttaataatttgtcggaaaattaattattcttcgtcacgtaaagatgattgattgtcttttgatagtttactcgtaaattacaccgctctttactacgaaaaagtgttggttgcccgctgtgtttttcgacccatgctgacctgacccggccaggtagatgacgcgtctttgcgtcaacagagttttggacggctgtaattttgtcatcgttattactaacagatacataatgttctctcacggtctcgcgacatgttaaaccctggcaactagctacgggaatcctccgtgtcttgcaggtatgggccagaaggctggctgagctgtgcggcagaagaagaatccggccagtatgtctctgcggctctgctccccggcgccgcagcccaccggaacgccggatgacggacagatacgacgcatgcatgcacgctagggcccagcagctctggacaaaagccacaaaacgcccccgccagctgctgctgctctggtccgtgctgacgacggacggctaatcgcctaatcggcagcggctggcctctcggcctcctccggccgacatgcggtccccacattgcctcttccgccgcgccgcaccacccgattttatttcccttatatattcaatccacccttgttgccttggccgtcgcctcgtctgcactctgcagtcccatttcccaaccataaccttctccccccatcttcttcttcttcttcttccattcttccttcctcccctgttcttgtacttgaattcggcgcgcgtctggtgtgttagccaggcctcgccccatccgaagtccgaccgaaggagggagagagagagaggcaaca

SEQ ID NO: 13228 - DNA, 384 bp, Zea mays
ctggaagcggccaggtccttcctgggacctaaccaagttcaattccagcaccacccaccgtcgtagttgtttcagcagcagcagcaaaacagtttccatggctttggtgtcaacccgcagtaccagcagcatgtcctcaaccagcttctgcaggaagttaagaacagtaacaaccgctcgaaagcgcagcaaccgcctctggatgcaccaccgccgaatgcgagcggcgggggtctcgcgccaggagttgctacccccaacgtcattgctgctactggggagcaggggcagcatgtcaataacagtagctctaaccataacggcacggtaaagggtgctgctggtactggccctagcaatgtcatcaacaatagcacagccagc

SEQ ID NO: 13229 - DNA, 1500 bp, Zea mays
atggtagaagtagactacttggtagttgaaatagtcaaggggtaatattgttctattgtagttatctccatgacaccatcagctagcctaggctagcagaaaggacggagattactttacggttgacctgactgactcggctctccaagtcttcggcctcctccgtgtatgtcctggcggccagtcttctcgtgctgacgcgcagcgatcctgctgggcaattgcttcgtyggatgaaattgacagaacgatttgtgcaggggagagagagagagacgtcggcgttgaaagtgaaaaaggatcgcgccacctactggtgtaaagataaagatcattcagtgtcaaggctggaagcctggaatcggccggcctctagtatagtagtgagtgagtgtgttgagcagatcatttcttcagtggatgccaagaattcgaacatggacacatgcatggtctgaagcaagtagggttttctatatctgcttcttgctggcactaactaggatcttccttccttcgtgtggtcctagaatcccagatgaaggttcgttcctgcaccagactccaagatctgctgcgcgacagagtaaacagctctatgatctgaagcacttggacagcattatatagtttgcaaaaaaaaaaaaacatgcatcatacttgtgcttgcccacccatattcaggttgtccttccaaagaactaactggcaagtttcggaggaagacccagctgaaactgaaaaacgcgaggcgagttggaattcggaaaacggcaagatcgctggcaagattttactgtggattggtgaaatcaaactcggagacagtcaggccggaaagtataagagcgtaaacaatgatgtttctttgtccatccatggaattatattcaaaaaaagaagacagtgagagcgacctggctgtgtgtctctacgtataaaacaccgaggcaggcagccacccactctccccattaacaaagcacccatcccttcaacaaacctcgagtcgagagagagaagagagcagacaacaagagacaccaacgaacagaggtacgtacaccaagcatcctcctccccctcttccttctttctctctctctctttttttttttttttttttgcaatttgattctgctagctcttccatgttcttggctcttgactcgagtgccttctcctgcggtttccttttttcttgagaattcagctatgtgcagtacaccgcatgactcacaagaacatgagagatttggatgagttttttcttcaaaaaaacatttttttactctaaaaattaaaccactagtgttaggctcaggtctataacagttgacatcaacgacgaagtggttacgggaggtggttgtgttgtgtcacctcgtgttcctgctgatcagggactttcttggtccgaattgattatgagagagatgctgtgccatggcctgcaggcaaaccggctcacgcctgtctcggtgcggtggccggctaatc

SEQ ID NO: 13230 - DNA, 1500 bp, Zea mays
caataatgccattgcgagtgattcatttagccttaaacaatagagcaaaagctttacaagagtcaagagatacactgaaatttggcttgaggcgcgctgttctgcaaaaacacgtactgcttattactctctcggttttttccatgtatacttagtgtttgatttgtgattgatgcacacttgacgctattatggttctaaatcctacagtacatgtgccctacaattcaacgctttcgtaaaaagtgtttgttagtgcggcgagcaatgtgcttatgtgcacgccatgacccatgagtgaggagcagcacacagccactagctactccccttctttaaaaggaaaccacgctgcacccgaggcttctccatgcagttgctctatctttttcctcaccccggcccgttccatcaccctcacggcaagccctgatcacatcatcctgcttgtctctccccaacctagctccatctctctttcatctactcttccatcgatcgatccatcggtaagaacatgcgatgccctctgtgtgcgtgtgaatctatgcatgcatggatctgccctcgttccttttcctgtccattttcccgtttctttcctgcttgctatttctttgggggtgtagtttcagttttgccgcaaatggggagctgcacttagaactgcgactagttgcaacgagccagaaaacgatctgcagcagcacctgcggggcgccgctggctccctgatctgaatatctgatgcgtagtagctagctagatctttcgcgtgtaaatttgttggatttggcgcttgctatatctttgcctctccatatatagatccggctatttgtatatcctcgacaacttttcttgcttctcttcttgaattacgtgctagctcctgcttaattttgtcatctccatgagtctacatatcttttgctggatgttgttgcacttcttcttgagatatatagctcctctctgctagctagctagatctttcagatctatgatgactttacaagttttttcccctctctcttaaaaaacagcatgttcttaagatctatttgatctgaagactgaatgaagcagcagctatagcctatagctgtgtgaacctttgagccatgaattgctgattagctttgtgttttttcctctgcacaatatttccccttctaactaagcacaaaactgaagtgcaggcatcctggcatgggatgggaaatatgtttgtgtttttaggtttatatttgttcctacacatacatatatctagttaccatacagtacagttgagctcctgcttaagtgcttagtttcgcaagaacatcaaactaaaccaatctttttttttctgtgtgatatgaatttgatttttcatattcaaagcatatatagtacaacggaatatactactgataaaactctcttgttcttctgataactatttgacatctatgaaagcaataatttctgtgactgttacagtactgcgtgagg

SEQ ID NO: 13231 - DNA, 765 bp, Zea mays
tcgtcgccgtcagaggggttctgccgatgggccccgcctctcgtccctgctgtcatcatggattaatcgcaccgagatctgagtcttagcccatgggccgagcgtgttgtacgactccattctggcgtcctgggcctgggccttgtctagtgagtggtctcgtctcgtctcgtccatgagttatgagtatacgattgtaataattgtactagtttatattttggtccatcaaaataaaactaggtcaagtggcccatggccattcattagctagcgctggactgacagggaccgtagcggcaagggccctccctagctgcttcaacgattcagagattccctccccttgcttctgaattctgatggcaacgaggaaccgtccaaaagggcatattcatctctcccttctccagctagtctgatgcgacgcaattgttgtgacacgacggcactgaagcgtctgaattgtaaactactacggagtaccaatgaacctaccaaccacgagcatattaaataaattcaaattcatagaaaaatagagacgttgcttcatgatgtgcacatgtgagaggagacggcatcacaaggacctaacacgcgataggtagcaagaatatgagcgagttggcacgtagatatttccatagacatccctgtcccacaaaaaaaatgcagaaacagcaaaaaacagtggtgccacaagttttagcagacagcaggggtgtgcatgtgaccccaagaggccaggacaggtaggcgcac

SEQ ID NO: 13232 - DNA, 1500 bp, Zea mays
atatctctactcctttaaagcaccagtttcttgtgtcgtgtgtcacgtgcgaaacttgttagtctgttgctctcccttgcatcttgcctgaccatggacccaataggttgttataccatagataggccatgatagactacccaacgagctcaacccgataggaagccacacacaacgcaacactctcacatagtaccacctcgctagcggaagggaacgagcgatcgagcgagctataaaaatgttcagtctgtttgtcatgcctggcgtggccataattattcttagggtatgttagattactttagtctcggtattaaagtttagtcattactctgtttggtttcagagattaaaaatgttcataactcactaaaaaatttgtaagaagaccaaaatattctttatcattctctcgccactactcttctcccgcgacaacggaaataaataaggggcaaccatgaaattgacatgttttaggggttgtttgaatgcactagagctaatagttagtcagctaaaaatatactagtagaattagctaactaacaaatagttagctaacgagtagctaatttactaaaaatagttaatagctaaactatatattagctatagggtgtttggatgtctctagctaattttagctaactattatctctagtgcattcaaataaccccttaatcccatttagtcactcraggaactactatttccggtgtcttattatttatcgttttggataaggtttgagtaaaacttataaattttttactataaataactattttgatattagtttgaaaacctaatacttatatgcataggtttgtcttaaaaagtacttttataaaagtataaatgtaataagagtttatttgtattttaggaaaaaacatcggtcaaagctatatatattttggagactatatcgttgtcctaaacgacaataaaaaggcaccgagagagtagggactaaagcggtttaatctatcctttactgttattgtttgataatttatggattaatgagactaaaattctatgactaatctttagtccccaaactaaacaaacccttagtatgattgatcctggacagcatacagacccatgcttaacttgatacaacaccaacaagaccagaccccacccccttccctatcaacggagggatgatatattatttaagtgcatgcacgtgctgcacgctgttatggacctattaggtagtagtaggtcgagtaggatatatatcacaaagttgtatacctataaatagctcgctttgataacatgatctgctgccttatacgaaacatagctacctactactcaagtatccatccttattgtaagtgctcttataagctactactagttacaagctggtttatatttaactacaagtagcaacgatttgtcttagtatatatggttcataatacatatatattggaactgagataatatatgcaggagtacagtgttgatcc

SEQ ID NO: 13233 - DNA, 1064 bp, Zea mays
tcggaaacgctaaaaaccgcttttaaagccgaagcttaaaaaacttacaaattaagcaagtcttgttgcgcaggagctaaaaactgagtaagcaagagcagatggcaaagaaagcgtaccaaatgacattgcggtgtgctcttatttatacatctggcgcattgagaacaggagggccccgcttgacattgactgttgctattctagcaagaggaaggtgttttttcggaccttcggcttagggccttcgtccatatcgcaatctgaatttattattctaacaaattaatattgcgaggggctactgttgggggccttcggcttccgaaggtcctcaaaaacgtgatttgacaatgtttctggagtataatacatgagcaggtaccttcggacacgaacccttcggacaagtcaaaattgttgtatgaagaaacacaaagagaacgaaggatggaacagagccgaagctgtgcgcaaggaagcttcggcatgatggcagaaaggaggaaaccgacttaaagaggaaaagactatttagaccccgatagattactatagagttattatcaaaagcaaagggcctggatgtaattttacatgggctgcgacccgtgcctataaataggtgaacagtactcccgtactgttcacgctgacttggcatttgcttttgcatcacgcttgtacttttaccttctttcaagtcaaaggtatatttgtaacccaacatcatttctattcttctatagcaataaaataaaaatgagttgataataatacataactattcatgttatcttttatattccatgtaattcctttttcattatgatatgtaatgtttatgaaggtatgtccttcataaccttcgtcctaaaatcattatatctcaagggaaataatgcttcgaaggacgaaggactttaacgtttaacgttttctgtgttgccttgttcttaactcttagcatttgagaacaagtccccaacattggcgcccacctccggtgaactcacttccactttttgagtttcgaacaccttcggcaagcatcgaccttcgtc

SEQ ID NO: 13234 - DNA, 621 bp, Zea mays
tggcgcaattgttacttatctattttatcaagatataacactgttaaatacagctaacggagtagaaacgtgcaaaagttttgttttaaaaaacaggaacaaacacggaaaggctaaaaaagaaggataaatccatagctatatgttaaagtaggggcacaaccgcacaagagcaaatataagagataggtaaaagtaaaagactacatgtatgtatagagtcgtacagagatggactcttcaagtagagcactaaactgctgcatgaacctcataggtaccacataatggtcgacacccagtttactttatgctaatagaattcggtcacgtgctaaatacaaggtttatcataaaaaattgaacgaagcgaggttcatcacaatagttgacagaagactgaagcgaactagttgccctgacaaactagattactgaaccaaaattttaagttgcgcagcccacagataagacatacagctacaaaaggattataagctaacaataactcgatgtctctcttacaggcacacaaggggagcacaaaaacaaaagcaacacgaatatatagatcgtcattacacgtctgcaacggtcacctcgacctcaacacccggctca

SEQ ID NO: 13235 - DNA, 398 bp, Zea mays
tccctagagacccacgcgtctatcttctatcccgcctacgcgcgtcgccagtccccgctcctccacagcgccgccgccagcccacgctcccgccgccaccgctcctccaccccgcccgccgccagcccgctcctccaccgcgcccgcactcctccacctccaccgcgcgcgtccgccagaccgcgcgccgccacctccaccctagctgcgcttcctcctccagatcccgacgccccggtcccatggccgccctcgtttctagctccagcttctccgcccgccgtcccttcgctctctagctccggatcgcacgcgcacgtaaagacacggagcccgcagccgaggatgccgcagccgctgcgccggactcgtgggagacggccgacatagacgggccc

SEQ ID NO: 13236 - DNA, 926 bp, Zea mays
gtgcgagaatacatgcatggctcgggcagctggcacgccatgccatgccatcatggggacacacacacacacacacctacctcgctcgccaataattctcaaacgctgcgggttgatccggcgctaagatggcggatcatcttcggatcggctatacgggtaactcgtgattggtgcaacggtaaccatcgaacaggaatctgcatctggcactgtctgtacagagacgagagtgcgagtgaatgagatccgagatccaagcagtacccttgacagcgaggagaccattcatcacattcaatggcacatcttgtgcgagaagatgggaagtatatgtatatatatttttcttcttcttcatcagcatgttgggtgtcttagaactgaaagctggagttacaagtgctcgacgtgcttctatctttcgaccttccatttcattttgcacttagatgtactccagctgtactcggaattttctcagagggttaaaaatggaacggtacgattgaacattgaaggagtggatgacagtcactttgtccatcaaatcaaaacaacatttgaagttcaactgaggcatctgatgttccaatggaagagagctcatgttgtttctgttgagttgcatgatgaccaaattccttatagagagcaaccctgcttcataatcttgcaggtaatccaacaagctgctccatcttcttcccaactttatactagtttatgtgcaaacaagagagatactttgtataggaaaacgacggaccatttaacgcacagttgcagattactattactggctgcagtgtaccatataatacccagggacaagacaacagtacatcacatagctagataactgcgaagccaaatacccgtctcagcgagaccaccataaatagagcttacacaacatagccaac

SEQ ID NO: 13237 - DNA, 78 bp, Zea mays
gggaagctggtgacacactatgtcgactactattctggtattgatcagttgtttcgtattattctagttaaggaagcc

SEQ ID NO: 13238 - DNA, 431 bp, Zea mays
gatcgcttttcttcttccccattcttgttctcaagtcacttgtaatcaaagcaagagacaccaattgtgtggtggtccttgtggggactaagtgtcccaattgattgaggagaaaagctcactcggtcaaggtgaccgtttgagagagggaaagggttgaaagagacccggtctttgtgaccacctcaacagggagtaggtttgcaagaaccgaacctcggtaaaacaaatcaccgtgtcatccgctctatttctttggttgatttgttttcgccctctctttcggactcgcttttatttctaacgctaacccatcttgtagattgtgcttaaagtttataaatttcagatttgcctattcacccccctctaggcgactttcaattggtattggagcccggtactttattagagcctaaccgctcaaagtg

SEQ ID NO: 13239 - DNA, 1500 bp, Zea mays
gtgtttgggattgaagttttttttcacagttttggggaaaaattactatagtattatcaaatactgcattattatatacagaatgatgtttgataaactaggtaaaatcttcgttttcaaaatcgaagtattgcacatattgtagttgatttaaagtattctaacttagatctagaccccagtttctaaaactgtagctgcgatattgttctgactaaattatactgcagtattttagaaaacaatggttttcaaaatctttgttccctaaacaggacctagaagacaaaacaaatgtaaggttaatttgacgatcattattaataatgtgcctcagatcaatttatctcatatgtggctctatccgttccttcgaaaacaacaacaacaatcgtgattattctaaataagggaccaacatcatcttggagtgtgattgtatttaccgcgatgattacagtatttaccatgattatgaagccgggcaactaggcaatggatcggaagcaaagtatgcacaacgccgcgtgggccgtgacgtccatgggcacgcggcaccgaaagtacacaacaagggctaaacaagcagacacgcgtcatcctcacgatgtggagagccgagagcaacagcgattgataataatcgctccttatatttatttttgtatgctcacgggctcacggctcacccaatcacaccttcctgcagcagatggcgttgcgacttgcgagtgctcgcacggcgctgatttgctgcaaaatgggcggtgcacaccgagggaaaagagagagaaaagacaaggcgagaaacgagtggtccgtggtcgtttgttgtttttttgcctttgcgatgggggatgaatgatgattcacgtgagtgaatcgtgatgcttgtggcggatgggttgtaggtggcacgtcacggtcattcgtcatggctcgtggctcgcaactatggccacctggtgctgctgccccgctccgctaacagttccgtactgaccgtttcgcccttctctctttcggacacgaggggcatccctccctcggtccctcccagccaaatgtgcagcgcagcggtcttacccgtttgtgttccccggtttacccacacacggcagccgaatgcccaaaatcctggggaatattccactttccctatacattacattacatacacgccggagcggcatttctttcgtcctctccaaaccgtgtaaataaacgggaaccttctatcctcccccttttgggttcggtcctcctccgtccgtcgccgtcgtcaaacctcaagcgcgacgtgtgtaaacggcccgcgccttcggcagacgccaacaacagactcagactatactcgcagcagaaaggttagttagctgagctccgcggggggtcgaaccgagactcttcgtcgcgcgcgccgcagggccagcccagcaggcggcggacgcgaaagcttgctcagctctgtgttcaccggcggcacgggccgtcccggcg

SEQ ID NO: 13240 - DNA, 795 bp, Zea mays
ggtaagacgcttttcctgccctctgaatatttacacacctgaccttagtcaagtatggcaatatttaacaccttatgtatagaaccaaacactgcatcagtgtcttgttcctgcctgactagacctagacaggcagatgctaccaaaatacgggcagtaccatttgccgttctgtatcaagtcgaacaatgataagaaggatcggcccaactctgctccagaccagagtgcatgatttggtgagctgagccgcagctttcgcagcattccccactgaataatgatgctgctgcacacagtaaaaggacagacacacacctagaaccagaagaccgccaaaagggctgtttctgatggaagagtggaacacacaatcagttggaacagtgtctacctttagcgagcagctagcaccaatttcttctcgatgacatggaacctggaccatggcctatatataagcctacatataccttttgacaatgcaaagtgaaggaagatgcccaggttggtcgtctcaggcagcgcaaagcaacgcctacacgttgcccttgcttcactcctactcgacctagtacagcaaacagttaatttcaagtgccaaatgcatctaaccatggccccgcaacgcagtcctatgattcccgccttaattatatgctcgccgcaaccactaccaccaccgatactgaaaacaaagagcagctgcaaataaatcgataagccgtctcacaccttgagcctgcaacaagctagcattgctgcatgccagcatccacgtagcatctgagcttc

SEQ ID NO: 13241 - DNA, 924 bp, Zea mays
cactctctctctctctctctctctctctctatatatatatatatatatatgctaaatgaagataaatgcattccaacgtaggaaggcatgtgcaaaagcagtcataggctagctattttcttcaaacataagactattctccacgcttaaaataggagcacatatcaccattctcatgggccgaaaaagtataaaagaaaagcgcaaaaggccatgatgagcttctagaactgcttgacctgagtacggtcccaatcccaacttccccaggcctccaaaaatctcacggcgacgacgtcacccgagccccgagcctgacgcagcaggagacgccggccgtttcgagaccgagactgtcggtggtgtggctcgtgctgtgccgtacccgtatccaaactaattccgtggccgcggtcgctactatcccggacgcgggattctacggcaagcttatcgtagcgcgaatataaatccagatcccatctgggttaaaggcctaaaaatcgcgtcctcgaaaacctctagtctagttccgaaagcgcgcacacaacgactacaggagaagacacgcgcgacggccacggccaggtagagacagatccatctctcacctcgccccaccgccctcgccgatcggggtccgccgacccccagatcgcttcttcgcttcggtaggtggccgagtgtacgcgtacgaggagcctcccggatcccgcctcgccgtcgtctgtaagatcttctcgcacatctcgatctctctattggagctttgggtttcgtctgtctgtctgtctgtctctctctttgcgaggtttgggttttgtgtcgtggagcggtggaggtgccgtgggagcctttggttaatccagggtgatctctgatctgcgatctgtgttggggcgtatggctctggcgtcttaacag

SEQ ID NO: 13242 - DNA, 983 bp, Zea mays
gctgccgccaaggagaaccctaccgacgagttcatgatagcacagtagcctatgcaagattttagacttgatgccgttgcactctgaccaagactagagcgttgcgttgtactgtgtaaccaacaggagcaagcaagtcgatagtacgtttgctaatcgctgtgttttgccggtggcccccctcagggccttttctgtgttctttctcctaccttgcatctgatcggcggccgctagtgacagtgagctagcttgatgtaacctgtaacgctatgaaccgtggtgtacctgactgaacctccgtaatagtagatggtatcgtgtacggtgtaccttttttttagcaacaagatggtgcggcctgtcttgacggctgaaagttcttgttttgttgtttagcaacaagataattcactatcttgcttttctgtttgtttgttaccccataaaccgaatcaggaatttcaaggatcatttgattccagttctgcggaattacccaatttggtcaaagttttaatataaatacaactggtcattgcattttgttagatcaaatatcatggggattttttttttgaaagggttagttcatggacctagtaacatacactgtttgctatccaaagatatgctcactgaaaacatacctcactgaaagatatcagttcttatggtgtgctataattttgcatgtaaatatgatggcctttcctccagcgaactgctttggatagcgtacctcaatgctatttccatccaattttatcaagccacacgcccacacaccttgtatatacatgcgagccagcgcgctcaaaccgtaggtgccaatcgccaaagatagccacgccacctccgtcactcccgccacccgtgtatcagtaactgacccgcggtcaccgccttcgcgctacggcgtcatggtcgcacgcccgcagcttcccttttcccttcccagtcgatagaagccgcgttccacc

SEQ ID NO: 13243 - DNA, 165 bp, Zea mays
ccggcgggggtcgctcgcagacgcgaggtcccggagccgcgcgcgcccccgcctataaaactgcagccattctcccctggttcccgcatcccactcgcagcacgagcgctcagcgtctcgtctcctcctccccacaaaaagccgctgaattgctccgtcggcgtc

SEQ ID NO: 13244 - DNA, 1469 bp, Zea mays
ctgataggaaagagtcgactgttagaccttgtttttgtaatggcctatcttctttaaaaagccgaaagataaggatttctaaaaacttttgcgttccggatgctggtctcatgtttgatctggtagcgattaaagaatgaatcttrctctggcgatcatggtgggattggtacacctctatacgctgtaaaatgaaggtactctttagttcatgctacgaccgccgattgttcctgtgaccacacgccgtaccaacagaaaactatcaacctatcggtatggtttgttgttcacgtgttatgatctcgctcatcagattgttcccccctcccctggtcaatggcggtgagttgattgaccaaggccttcccttacgacgatggaatttcttccatcggcaagactttgtttgtctccttcaactttaatgaaaagcctagtctctcgatactaactaattagttaggagaggtgcttacttttcttttgtagttaaggattcataccccatcccattcctttttcttttcaaagaaaaccttaccatttgagttttgggccgctgttaccatttccatttccggaacctaactaatacttagttgtttccatttcctcatctggtgatagatcctcatcttcttctggctcaaatccctttttcatatccagggcaggctttaggtacgctttagttttaaatcattaaagatatgctcgacctcgtttatgtccatggtaccatcgtacgtaccttctactatcaaccagatgagatagggctttgaaaggtcagagtcagtctcctctttcttttaggtcgtttagcagttccccaaccagctttctccccgagaaagccttcctgagattaaaagaaaaaggtttgaaggtgggatcagtgatagttcggaaccagcaaagggaggctgaaaagccgtagtgctaacgcacgccctgtagttttgaagcaggcttcgacagctgcgagctccgcgtcgaaaagcgaagcgagccgcgctagcgcgctactcttcctttatgagatgagcgagactctatccaaatctactgatctaagaactccgcgagcgaactgagcgagccatgaggcgcctatcggcaaggcttggaaaagccttaagtttaggcttaggctcccttccttcactgaactgattcacccgggtccaaacctgctgagctagctaatttttcctttacgagatctcggctcttcggaatgattggagagagccccgcctcctcttggttggtgccgggcccgggactacttcctgaaagagcctttcgttcgggccggcaggaggggccctgatctatcaattgagggagcaaaaaacaggctttgctcccctttttttaaatgaagaaagaaagaagggtcgaagtttagaccgctcacagtagttctacccatagaaaagatcatgaaagaggcgatcaga

SEQ ID NO: 13245 - DNA, 1162 bp, Zea mays
tgcctccctttagatccgcctctaattagatcatcttcaacaactaatatttctgctcctagtttctttatatattagaatccttctaaaagtctaaatccctaaaaaaacaccgaactctaacagctccttaaatatacccaattagaagagcagtcagccaatcaaaaacgacagcacaagcatcggcctcgcacgcacacatgtatctgcaacacggacgcgagcacgctctagaacgtgggagtgtgaaaaaaaaactagatagaggcagcggtggctcgaccctaaatttatattgctagtctctagttttggggcatcaaaaaaattgggagcacatacatattaggagcggttgaactagtattttttcatcttttatgtctaaactatagttttggaagttaattagaagatgtcgaagatgctcttaatttgcatgggcttagatagtcagcacaaactttgtgcaagttgggccaggcccataacgtgttcggaaggccgaagtcgacacaataacggcactggacagtgtattctgacgagtggcagctagtagataggctggtggccgccgatggaaacggaagccacgttcctccggactgaatattttgagtttctatagacacgtcactggtgctccgggacacgcggaagcggaagcgaagcaggccaagtccggcgagctgacttcacccctagttgtagctgtactatgcctctatctgtgtggaactgctgtatggatgattgtctctgtctttgacagctggcccggtccctaaaatccatcgaaatcctccgatttccgaagacgagacggatatgcggtgtgccaatgtcaaatctctgatagcattggtcaattgactcgtcctgaatgcctcctcctaacctttggatcaacaatggagggcggggaacgcacgcgttgcaattgcaattgcaacatccgaacgcgtcggcgagctaggcgagcagatgaaccccggtcactgttcccaacatctccatcgacgaacatttccacgaaaatctcgctgctctcgcgaaaaaaggacgccacccgcccttgcttgctctccagtttgcaccctggaggcaggtgcaggggcgctcctcgccagcgggcagtcaaccgcccgcgtcggcc

SEQ ID NO: 13246 - DNA, 304 bp, Zea mays
atataaataaagtaccaaagtacgcaacagaataaaatagtccataaaattctctgtaattttctataactggaaaaaatattttagaaatttcctgacatttctatacagttttactaatttcttttactgtttttttccaatgtatacagaattgtgaccaaatttttttttcatagatctggcatggttattatttgaccaacgtcaaatatttaattcatgcatattctatgattcaatatttatttcatatgtactaaatattttctgttttaaattttgcaaacgtgcacatactgct

SEQ ID NO: 13247 - DNA, 532 bp, Zea mays
ggtgtgttgatcttgccgttccgcctctaacgagcgtcaatccagtcgtccaccgtggcaccagagacacgaccaaccgcgccgtagatgaccgacttcacaaacgggacgcacgtgtggctgcagagctgcgcgcggcgcgggtacctcgcactccagcgaggacgggtccggcgtctccctcagcaacagccgcgccacgctgaacgcggcgtggcaggtgcaccggatcgtgcacgggggcgtcgactacgtccttctccggtccgccgcctacggccgttacctcgcgctctcagcgtccttggcggcggacggccaccgcggccgcgaagccgcccagcgcgacttcaacgagccgcagcagctcaacgtcaggtggagggccgtctcggcgggggacggcagtggctacgtcctcctgtacaacgtcttggtgagcgaggaacgcttcctccgcgccaacggcaggtaccgccgctggaactccggcgtcaccgtcgatgtcgttggcaacgggggcaggagcacg

SEQ ID NO: 13248 - DNA, 1500 bp, Zea mays
attgatcacacaaaaaaatatatctcagtttttttaaagaggtgtgttgacaactaaaagtgactctaaagtattcattagactgccattatatttctatcatcgagatgatcagaaagaatgatgaaaaaaattagctggaaccagtctagccaattctyaaatcgtgaagaccagatttgccaaccttctcaaatggaagaacggattacgcaatcgtgcttctcgcatcgagctaataaaaaaatatggatcctcytcttgtttaaattttacataaaataaactcaaattttcaagtattctgtgcactgggctcctcaatttgggaactggccaggccagttgtccaggccagtttgcctgcctgtatggctgccccattcccttgaacactgacgaggctagttttttttccatattgattggtttgtaaattggtttcagatctatttttgacatgtgaaacttaaagattacaatctgaacttgtttttactcagattagaccaccctctgtataaatgagaagaccagggatgaaagtggtaatccgaactgttagaacaaatttaatattttaaaatagatatgtataaaatttgatgttgatcttttcttatgttatcaagcacattagtacaaatatgaataaaatattatataagttgttttatgtattatttgctccctacaacacaaaaagttgaaaaaattaccgaatttgtttccgaatccataccgaagtttatatctattatttgagaaaatgtaggatgaatttgaggtttaccttttatgaatcttaacaagctggatgttaaaaacaagaatacaaatttgtattgtatattctatatcctatttattcgcaatcaaagaaaaaactgattaccgaataaataccgtttccgaccgttttcatccctaactactgaaactctcagctctccagggcagctccacacaccaaataaaaaccctgcactttagtaatttatgcaggcttttgggggggcattatcccatgctcaattagaaacgtgggtgcatccatctgagcctttttggtcaagggtcgctcaaaatagcgtgcgaaattcttgaatgaatcagcatccgcattttcaaaaaagcattggatcccagcatgagatgtaaaaaaatgcagctgtcatcttccagtttccggctcacccatgccatatcgacgttcatataatttcaagtagtgattatacacaaacatgattttctcgtcttaagtagtgcttgcggtggttcttgttgaaatacaggtaatcctgcggggcttcattgcacacatgtcaaaaaaaatgagagagggcagaggagaggaggaggaatcccatgcttctttaaattctgctgccattctgctaccgtgggcgtcgtacagcccccgttcccatagaggacagtctgctgccgcaagcctagcttcgtccacctctgaatcaagaaacaaaacaactaggc

SEQ ID NO: 13249 - DNA, 1179 bp, Zea mays
gtaatgtaagttatcgtattattattcggctccgttgcaacgcacgggcactcacctagtatagggtgagttctaatctccccccatactttaattactccatttctttgtgatattaacctttttttaaacacggtaacctgaaaacaatgtgtattaagatagtacaaatagtctatgattttttcaaacttcaaaaagtgatagaaaaatgttaaataactgaattatagtatataagaagagctgaatagagtgaatggttggagacgtcctggatgtgcggacgtgtctttagggtgatgtagtaaaatatgatagaaagtacatatagggagagaaatgtgggaggaatggttggggatagtcttaatccatataggaaccagtgacatgttgcatacccactctagcaccgattctgcaaccagaggtatcccaaatggaagcaactgaaagtatctttcctcaaactaataaataacatgcaagcattaatggcagctgtttgacatgttagtgtaatgactaaaacgtagcctagtggactttcaagttactataacacaattagcttttagctttgtttgggtactctagtattgatctcaatccacatgtgttgaggtggattagagtgtaaattagtttaagttacacctcaatacatgtagattgaggtcaatactagagtatccaaattagatctaaagttattttatgggtcaaggctttattttaagatagtacattgttttaaagcaatgttggtcatgctcttaagattttttgactgacgtggcgctcgaactagtctattgctgttgctgcagcggctcgggtcaagagagagaggagtccgtgggccgttgctcaacccacgcgtctttctagctcaaatgggcaagtaggcctggatgaacctaaaatgagcccacatcacaaaatttcccctcgctcctagcactcgagcactcaactgtcgcaccatcgggacgccgcggcggcggccagcacgttcgaggctgcggcggcaaggtgggctgtcgtgcgaggtcagcgaggacaggtcgtctgggagcacctgaggctgtgcgaggtgccggcaggctatgacatttctagagtaagtaatactctgggggcatctcccgctcgcttagctgtgcccgccaggcc

SEQ ID NO: 13250 - DNA, 277 bp, Zea mays
gagcgttatcttaaggatgtgcataaatgctatcgtggtgaaccgcgataagctcgtgaaatagatgagccgagcttgggttgagtcgagccggggtctggtttccagacctagcccaaactgaaaaaattgttcttgcttcccgatttccagtcctctgtcgtttgttgtcccatactcccatctgttctccgcgaggcgcaacgaaggcacaaaacccttacctccatcaaaccctagcgctcgctctccccgtttagctcccgtcgccgctacc

SEQ ID NO: 13251 - DNA, 58 bp, Zea mays
ggacccctgtcttctgtaagcctcgtctggagctcttcccgttgcattggcggcggag

SEQ ID NO: 13252 - DNA, 1281 bp, Zea mays
gccttttgagcttagagctcaacctatacctaatggaacacacaactaagggataccctttgcgtcctcctacgatgacgggcacatttctctgactcttttggtacatctgcacaggaggcaaagagcgaaaatcccttaatgtgggaaatcctagacgagcagcgcttgaacatagaacctaccaccccacaattgggaggcggaccaaccaggctacagcctggtccccgagaattatttgttggttgaacttattgtgtcacgctggctatgttgaaagaataaagggcaatacttcattttgccaaattttaactaattttagctactctaacctagctaatgaactaattattactagtacaatgctcgtgtgttacgacaatacactaatcataaatgatgatataatgtaacagttgtacgatatgagggtcttgtgacgacaatacactaatcatccaaaaatataaattttagaaagtraactcttcccagaaaataaattttaaatgaagtggacatacgactttatcaaatattaaactacatatacttcaccttatcttagtcaaaaagcaagaaatactgtgcagcatgtgacttcgtgtcgtattgagattatatgttttttcatggttcatataaaaataacgatcttctaattattagacaaaacatgggaaaacaagtttattctacacgcattgcatgtacgtaaactcatgcttcaaaggaaataagaaaagttgaaagtctagtaacaactagctaatgctttaaatatgctattttaaacctttaaaattaatattacgtgtcactaaatctttaatatatctctacacgttccaaatagaactttaatagacccctctttctcctaccgaatcttcaatttttcatttgccgtcgcctactttgttatctgtttcgagtctcttcttctactttctcccgtcccgttcatttatttatatataaataaattctgctaagctctgctctgcttctcgccctaccatcgcctgaccgacgcgcccgttttctcctgaaaacagaaggctccggcctccggcatccgccaaaaaggggaaaaaaggagagataacacacacacacacaaaccccaatcccctgcggcggcgatggacccgtcatcggcgggctccggcggcaactccctcccgtccgttggccccgacggacagaagcgggcgcgtgtgctactactacgacccggatgtgggcaactactactacgggcagggccatccg

SEQ ID NO: 13253 - DNA, 418 bp, Zea mays
agtccaaccaatcagtggaaacccgcgtgatgctcaattgctcacgactatttcagcaaagcttaatgaaggcaagtgggcggctactaccttcgcgggggaaggtgccggcggcgagaagtcgagcctggccctgccagtctcgtggaggtccaggaaggacccgtctcgccgcagccgtctgcgcctccacctggacctcccgccgccggccgagtccttgggccggccgccggccctcgccctgcgcttcgggttggcgatgaggaagtcggtcgaggagttggtggcgtcggccgtctcgggctcgcacgcgccgccgcgcgggaccttgttgagcggcgaccagattccgctctgcgagtagtcgaagtcgaaggcggatgggtccgggaacttgcccagcagctcccgcgac

SEQ ID NO: 13254 - DNA, 796 bp, Zea mays
gaattaaaatattatatattactcttcatgatgatcaaatagaaacgatctttatcaaatgatcattcacgtgcattgtccaataaatgtaattactcaaataataacatatcacatcattcgcccacccgagaccaaaccagagtcatccaaggccattcggccgatcatcactcccacacgccaacctcgtgagtcggcacgtagcctgcatgccattttttcttataccaaaggggcactaacaaatgtctggccctttaaccccaaacaatacgagttcataggaacaataaatagtaataatgagtaataagcaatataacgaagcactaggctctgagctacagcctacaggaacagaaacgtgctcagtaagtccttcaaagcactttgactctggttagctgcaagtccacaactgataccaagtacaacagctgtcacacatcgaaccaaaatttaatttacatgtaaagcagcggaaagaacgaaaatccacttgctcaatttcagtttcaagtactccataccctcaatcagacaagatagcgaaatcacgctccttgcagaagtttcaggatgggcgcaggaggctaaaattgtattaaggaacctgagcagataaactcaaccaatttcatggccattatctgctacaaatacaaccacaacaatctggaagcttctggaagcaataacccgccctgcagatcagccatgctgagaacatatatacactcctgatcaagttcacctttgttaaaacttgaacacctctgccaaatgtgttgtc

SEQ ID NO: 13255 - DNA, 368 bp, Zea mays
tagcaacagactagtaaccaatacgaaggaaagcagacaaacgggtagctccgcagagatctccgtccgtgacttgccccaggctgtggcggcgtcggagaggggtgtcggcttcggctgtcgccaatcggcgtcggggaactccgatgattgttttagggtttgggccttggcaattggtattgggccttccagacagatgaacccaaataaaggtggttcccacgttccagtgacttgcaaaggtggcgcgtggacccgacctgccagtttttagtgactaggctttgcgccttctaaaaccctagcttcagaacgaactaaaacccgcgatctgaagcgactagtcgaaggcggcggcggcggcg

SEQ ID NO: 13256 - DNA, 368 bp, Zea mays
tcgccgccgccgccgccttcgactagtcgcttcagatcgcgggttttagttcgttctgaagctagggttttagaaggcgcaaagcctagtcactaaaaactggcaggtcgggtccacgcgccacctttgcaagtcactggaacgtgggaaccacctttatttgggttcatctgtctggaaggcccaataccaattgccaaggcccaaaccctaaaacaatcatcggagttccccgacgccgattggcgacagccgaagccgacacccctctccgacgccgccacagcctggggcaagtcacggacggagatctctgcggagctacccgtttgtctgctttccttcgtattggttactagtctgttgct

SEQ ID NO: 13257 - DNA, 1500 bp, Zea mays
ggcgctgacaggcggggcccgcctgtcaggcaccgagggcgcgcgggcgtaggcgcgcgcgggctggtcttattgggctggcttgggccgaaatggccttttcctttttcctcgaatttctattgccttttctatttattttctctagggttttgaattcaaattcaaatcaagtttgaaattcaaaccaaatcaaatatgtgcaacaactcaaaaaatatttaggctcagtatgatgcaacattccatgactcatatgttttgggcaaaataaaataaataatccttcacttatacaaccaactctaattaaaagaaaaagagagggagacagctagagagagagagaaactagagtgagatagagaagagtaacacctgaatttggatgatcataagaaagaaattttatacccccaaattcagtgtgttataggtaggctcggctgacgctcgtgccctagacagggacactgccggcccctgtgcggatgggaccactccgcaagaagggcccgccaaggctggcgcagacctaggtccgacctcgaggctaaagccaatgcggacctccatccccttgtcgtcgtcctcctcctcctcggtgctaggagaggcctcgagcggaagcccctcccttgcctacggtctacggggattttcgagtgaatcgcgggcctgcatcttcttgcgggcctgcttcttatgctcgtccttcttcttcttatcctcctcggccgccagccgacgcacctccccggcaaccacgtctgttgggggccttcgtcttccgaaggtcctcaaaagcatgattaacaatgtttcccaagtgtaatatatgtacaggaaccttcgaactcggaatgaagctgtacacaatatgaaaagcataatcgggacgaaggttgaaccagctccgaagctacgcgcaaggaagcttcggctcagtagcagaaaaaggaaccaacttaatgaggaaaaggttatctagtcctcgatagattgtccttaagtcaatagtaaacatgaagggcatgaatgtaattttactcaggctgcgtcctgtgcctataaatagatgaacagtacccccgtactgttcacgctgacttgtattcactcgtgcatcacgcttggactctttgccttctgtcaagccgaaggtacaaatgtaattcaatattgttcatgttcattcatgatgatataaagagatatattaaggatgtcatatgatcattcatgtcattcctcatgtttcatatgcttcttctttcattaatatatgttgctatgatgaaggtacgtccttcatgaccttcgtctgaagatcattatatcctaaaggagataatgcttcggaggatgaaggactttaaccattaatattttgtgctgccttgttcttaactcatagcatttgagaacaagtccccaacattagcgcccacctccggtgtactcacttccacaatcttcggcaaagcatcaaccttcgtc

SEQ ID NO: 13258 - DNA, 1500 bp, Zea mays
cagtcaaattaagcgacttgctgcataaagaaatgggattctgtgcactgatcttgtggtggtattttacgcgtttcggagacaagaacggaagaagaaaccccccgaaatatcttaagttcgcctttctgtagtctgtagactttacttttttatggccgtctgcgcagaataatgctacctggttggtctctaacttcgaatcctcgataaagtgtggctgccataaaaaagtctgacgacgagtaaaactgaagctatagttatagcaaagtttgacgataacatatggtatatttctgaaaagaaaaacgtgacgtcgtcgggcgcgcagatcgacaacgccggggcggggcggggccgtcgtcgggtggccggagccggaaagaagggatccaaacaagcaagcggcctagtatttcgcttctgctccccactttaagttcacaggctttattactaaaaaaagataaacgatccgaatgagatacttcacctgcggctaaccccgcacttttattaacgacagcgatgccctggattagcagcagctgttccatgcggaaaaggatggcatggcaccggcgctagatagactttggacgctgccggcgatgatccagtgtgtgatctcacctgtacgtcacgctagcatcaccagtccgaccgagtccggccggatctgtcaggccgtgtgaaacctctcgctgccggtcagaaccggagattcttcagagcgatgagagatgaggcggccgctcggtctggtcatggaacttgggaagcgttgcttggaagaacaaaaatcccaggcaatgatcgcgccatggttgcgcttgcgccggccccggtcccactgtgcacgatcaatctggtccagacatttttttactagtacgttagtagtaccttgtagcagtaagagcacgggttagtacgcgagaccatcaacaacgtggcgctttaacggcgagggattaggcttgattgaccgacgataaggcgatgaccgagccgcccgcttggcgcttgctgatgcgacgctgtcacaagccgcgcgtatgcaaccggacaccggaagcgtcgcgacgcgggggggcattgcgtgcgcctggcgtcagcgtgacccgccaagtgaggcgtcccatccccattccccaagcggacggaagacttggcgaggagagggggagatgcgcccacggccacggcgtcatgctttatattctcgctatcgccgcgcaaaggaggacggacaggagggcgagagcagctgtcgcttttgacctatcggggggcgccgggcgggcgtaacggaaccaaggcgggcaggtatctgctgtgctgctacgagtagtaagcactatatataacggccaacgggcaacggcaaagccatcgtcgtcgtcgtggaactcgtacttgcgtgcgtgcgcacaagaacgcgggtcagagctgctggcggttggaggagcagaggagatcgctgtgcgggcggcg

SEQ ID NO: 13259 - DNA, 905 bp, Zea mays
atttcccaccatcctgtcgctccaacactggaggcccttggctttggccttcaatttgagagatagggtctccaaagggcatggctgctgctggacagaattccaagcagcagacacagcatcctgaaacccatcaaatctaggccaaaaatgctcaaaatgaaaacgcctcttcccatgaatattatccttcaaacccaacaacagaggacaatggtcagaatcatctgaggctgttcactctattatttagtatctgtttttttagtcacaacagttctgataattacacatacgagtatgatgcagtgatccacttagcaaatacttgatgttttgtacaaagccatggtccccaaaacagagcttgggccactattttttattaggatataaatgaacatcctaataaatttatgcttttaagtactttcgaagacaatgaccttcaagtttctaaactaaataccttaaaagttattatttgtaataattttaaaagtttgactcaaattttatgcaaaacctcaagtatttgcaaaccggagggaatagcttgatatttaatgggggaaaaaagaaaaaggtttgtactggaatgataaagaggtggtaaaggtgtattgggatgaactccattttcacttaaatgttggtgtgctgggttggtgtggtatctacctctttggcagctgtagaatttcttgagcttcatacataacaactaatatcttttcttaatatatcaggagtcaagaaatggtgcggacaagccagatctgaaggaatctatacttagagaggttatttctcctattttagcgacagccaaacgacatgaagggtaccaaacactgtggcagatttgctatgatctagatgattcaggtctcctccgcagccta

SEQ ID NO: 13260 - DNA, 425 bp, Zea mays
attttatttctcaaaagtaaaaggatctaaacagccttaaaaatgatttcagaagatgccgaattcaatgaagtccgacagaaggctaaattaagaaatctgatgaaccatggagaagataacatcaagtccgcgactactgtagtctgtaggcactaggccgtccattctgcccagtgcgcacgacggccaggatcttcaaacggcacgagcacggcagcggccgtcgctggccactcaccgcgcgccacgtacaccacaaaggggcatataaagatgccaacccaaagtagcgtgagtgcgtgacgcaccagctgcttcccccctatatatatctatataaaaaaagaaagaaaaaaaatcggacaaacgtgtggcgtcggcagccgggcaggtaggaaaaggtatcagcgtcgccaatctcc

SEQ ID NO: 13261 - DNA, 1500 bp, Zea mays
cgacctgctggcttcccttcgtcttccccgtaagcccctatgttcatccctactcttcatattctgcggcgatctgttcgattttaggactttgtgttcggattaggttgggattggtgtcgatctgattgtggatccgattggtttgggttgaagattggggcattaatttgtcgtttatgcgattagagatggttgattgtggatccgattggtttcatcttcgatagggtgttgttgcttggggttgcgaattagggtttttggttggttgtgtagtgttgacctagggtagacttatcttgcttgatgtcgatttggggatgaattagagatttgattgatcgcgacttcggtgcttcactagaatttagttgatttcctcccggataacatgacaaatgtgaatatgcctgtaaaagttgtaaaagtttgattagatggtgaactagacacatctatctgcttgtgacaactgtccgctcgtcgacacttgtgtgggtagtttagaatcagctgtctactggcatgccttttttggtcgaatttgaatatgcctattagtgcaccctataggttttatggagggggttaatcatgtcatatcatcttagcgatgatacaagataattcttttaagtatcatgctagcttacttcgaatattccatatatgattcatctgtatgttcactatcctgttttttcttttcatgcaggacactgatcctcaccactcatgtctgctgaagttgccggaggaaacccttatttcctctcatgctacttctggttcatatactgcataaaattccgagatttcacttgatacaagtggaacactaggagttttgtgcaaatacttcctaccatgtgaatcagttgtagctggtgaatttggcaagactcaagtcctctcatctgggttcagaaaacatctgtcggttgattgcttggtctcctgtttcctttgagtcttgccaaccaaagttttctctcagcatcagttgtggtctacgaactctttctgtgacttgaccaacatctcttttggtcctgtcaatcttgcaacactcccttccaaagacttgtctagaggctggattgccctgctctctgctggcgctgcatcctcctttagtcttccaagttttctcttggcagcagttgtgatctacgaactctttctgtgacttgaccaacatctcttttggtcctgtcaatcttgcaacactcccttctaaagacttgtctagaggttggattgccctgctctctgctggcgctgcagcctcccttagtcttcccttgctgcattctgtgctcactttcgaaagctgctctgttctgctctgctttattgatttgtgcacttggattctcttgtctgtgtaatcaagcttctctcttctggggcacaactagtcaccccattgaagcatttcagcttttgtcttgagatctttctatcagtgctaaaggcaaaagaggtcttagggcg

SEQ ID NO: 13262 - DNA, 232 bp, Zea mays
catcaggagcagaaggagagcccgccgccgccagctacagcaaaggcaacggcaacgacgcgccaaaccgaggcgtcgccattctcggacaccatgaccgcctccccactcctcttcctcgacccagcagcacccgcaccagcgcccggcagcagcagcggcccggcgctggacttcctcaccgccgccacccaggagggcaagcacatccaacaggaagacgacgacaacg

SEQ ID NO: 13263 - DNA, 1500 bp, Zea mays
tggaagggagtggtaagtgctgtgccagtctgaatgtaaaggtggttgctttagcaaacaatgcgggggggcatctactgcatcagtaccagtgttaactggtaacaaacagggtggttcatttgacaatctaaaaaaagctgtatgctccctcgaggtcgagggcctccatggtagaatcagtactgacgagctcatctcgcttgcttttattagtgactactggcgagtctgctcggtacgcttggtgtgaatgggctagctagtgctgcttgagaacagttctgaaatcagttcaatctttctctttttttttcacgcaaagtggaagggaaaaggtattgatgagcaaaggcaaaatggaaaagcatccaagaatacggaacgcagcaaggtagtagtacgtttcaagtgcctgatgacagacatcttttacgtccagggagcgggtggcatttgttttttttttttttgatctatctcacagtgatggaacgaacccacatgggtgtggagcagacaaagggcatgtttggttccctgcctaacttgtcacactttgcctaacttttctgcctaaggttagttcttcaatttgaacgactaaccttagacaaagtgtggcgtagttaggcacaaaccaaacatgcccaaagtaatgcatgatttggcaatcatgggtggctgtggctctctctctatctctgtttactgcagtgcagagccatccatcgtggagagaaaactctggttcatagagaaaaaggggtcgcaattcctgagctctgttgggagggaagggattcagttcagtacagcaataggctgaaacatgcaagggattcaatgcatgagccatgttgttgttgttgtttttttttttttttttttttgctgctgcattggtcctgctttgactagcatacgtcagatgatcagaaagactggaccggggacagaaacgagaaagctgtgaagaaaaacaatagtaataataataaccaggagctggtcaacgtgggccaaaaaaatgtactaccgtgtggatccaccagtttttgtgatcagacgaggggcccaagacaaaagtttacgggagagagagagagggagagggagatcgcggaccggaacgaacaagattggcattggcagtactactattcgttatcctgctgaagcacatggttggttgccttgggtccaagaagccagagagagacggagacctgtgctgtgccataaacaaattcacgctgtcacatgcgtgtaacgtgcacgcgcatgcatcccagcaagcaatctgtgtggtgtgagtgtctgtcacctaccctaccctgctcgacaaggcaatctgaaaatgctctccgcaatctccacctccgcaatctccacctccctactagtagtactcttcggtgcagtccgcatccccacatctgaccgactctcaaagttcacagctccaatcctggtgcaagcgcacagtagcggagcaag

SEQ ID NO: 13264 - DNA, 1500 bp, Zea mays
aattcagatgtgattgcaagaggctgatgagaagcaccgtagcagaatgcatcatcagtaagagaacatggagtgaagccttctgattaatgctgcatagctatgcaatggaggttctgttatcgaccgacttcaaacattaaatcttaattggataggcataagtagttctctgggagaagctccttccttctcattcggctgctaggcagccgtaatctataaagacaaaatactataaaccgcagcaagtggcagcgaataagctaggaattataaacgcttgcaattattaatgagatgtaatttcatcaatatcgcagaaagggcaacaatatagcgcttggaattgttattgagatagatataattttatcaatattatagaaagggcatgaatcttattttagggcattaaaatacgcagattttgttccgtgaaaagaaaactagccgttgtgaacattggaggatcgaaacgttcatacaacgttaggaaagaagaaaaacaccaaaaaagttgtagccgtttatgatccaagtattactttatttagagctagtctgggaacatcagttttccaagtgaattctatttctcatgagaaattggtttattttatcttgaaaaaataagaattgcttagagaaataagttcccgaactagtatgcaaattaaccggttagagcatgtgtatcataattccatttctttgttgttttatgatcatctacatcgatgagaataaaacgcaaggcttgactaatatatatgtatacgatcgagatgcatgtggatatgtacatttgattgaaacattagtgcatggttcattttctagggcttctgcatagtgtcgggctcgcggctaccgctgcatgcatggcgccatttttcggagagagaaagggaaaattctcgtgcctttccacgctggcgaaggaatccaaagtctgcgtggacagccacgtagacgaaagcggtaaaattataacatcttttatattataatgataaatatgtaaagtcattcttaaaagtgatttgggggccaaattccgtaagaatggaaaatataattagggcatgtacagtggtgtttaatatgggggttcttaaggtgttttagggggttatttgcaaaaaaatcttagagccgtctctccgtgaagagacgcctctggctcgtaaaccaagtaacaacagtctcttagttgtctcttgtgcttagagaaccgttttggtgtctctccactgtacatacctttatcccagaggccgagagagcgccaaatgttgcagatttgggggccgggcctcgggctcgcccttgtagcgaccgagccggcccgttcgagactcgaaccggcccgaacccattggcgtggtccgaccgggcctgacccgccgatcagccgatgaatcagcacgcggcagagtgacagacgcatctcgcaagcagcagcagagcagaaactgagggaagcgagggacggcg

SEQ ID NO: 13265 - DNA, 794 bp, Zea mays
gttcaaaagacgttcctaaggggatgcagaacttacaccgaaaataagcggtgaagctgaaaaataaacggcaaagagattttttatggttcctaagggaacgcagatattgtgtttcaatgtgggtacgtgtcttcggcattagcatcattctttgcatcatatcatcgcatcatatctgttggggacttgttctcaaatgctaagagttaagaacaaggcaacataaaaagtgttaagtgttaaagtccttcgtccttcgaagcattatgtcccttcgggaaataatgagcttcggacgaaggtcataagagacataccttcgtgaacataacaagtaatgacgaaggattcatataaagcatgaaatataatataagcatcatcatagaatcatttctattttattaacatggaaaaatagaaatgatttcaaattacaaatgtaccttcggtcctgagagaagataaaaagtacaagcgtgacgcaaaagcaaatgccaagtcagcgtgaacagtacgggggtactgttcacctatttataggcacgggatacaacccatacaaaattacatacatgccctttacatttggtgataattccatagcaatctatcgaggtctaaatggccttttcatctttaagtcggttcccttttctgcgaacatgccgaagctttcctgcttcacagcttcggcactgccaaccttcgtatcttttgaggttctccctctttgacataagtccgaaggtacctgttcacacattacactctagaaacactgttaaatc

SEQ ID NO: 13266 - DNA, 204 bp, Zea mays
agtgcgtcggcatcgatgacacctgaacccacggtgattggatcggtgaccggaccaactcttcaccatgctgctgaacccttccgtcgaccaggcgctggaccggagatggcacgtacaccatactctatgggaggtattgtcgcgttgaatacccagcacccttggtcctttgttcctaattcagtagtgtagactgcttcg

SEQ ID NO: 13267 - DNA, 871 bp, Zea mays
tcgcacgcggtctgcgcttgcagctgctccacggctcgcggccccgggaacggccttttgttgcatcggggctggagtggagcgcccttgcgctgtggtatctgttgtgttctgtccgtagaatcgaatagccatccagaactgcacgaccgcgtccggaaagctaaagccggtgatacgggacggcgtaaatgaatcggcagggggtagacgggtaagtacgtcacctgaaagcgcaagaggtgcaacttgcaacaagtctttttacggaaggcgcgaaatggcccgatcggataaggccgagtcccaactgaccgaagtgaagtgcactgggggtactctgttccgtccgatcctgacgacgtttcctaatcagccagctaatacccgggctgtagaccattcctgctgtagccgcccggcaagcaatcttcacatgggcggacgtcacagagaggcccatctcgatgctgcttgctgtattcagaccgtacaagctcgtccgtcaacggaaaactgttaggtgcggggttgccatcgggagtgaccctgatctctagtcattcagcccagtgctgcacgtctctcttcctgcgacacacggttctcggtttgcccagccggcaggcacacacaacacacggacccgttcaacggtttaggttcaccgaccgtgtgtgtgtgtgtgtgtgagtcgcggagtggtgggcgcgcacacacaattccctcccaccccacccccaccctcctcgtctactacttctaccgcccgctgacctgaccgagtgcacctccacctttccactaccccccgcacagtgcacacgcagttcgcacccacgccccccgcaggccggaggagccagccgcg

SEQ ID NO: 13268 - DNA, 455 bp, Zea mays
gctcggtacctctgcccacctctcgggagtaaacaactgtaaatgaagcgatatccgatctcacgctatctcgtaacgggctgaactgaaaatcacaatccaatacatttccatgaacctaaacgcgtcgttagatctactctattaattttaccagctaataactacggtagtctttaattttagtcggctactatagctgcatccaatgctaactgtaggggcaatcgtcggcccaaaccaaaacatttgcccagtggctgccacacccacacctcatcctgagctgctgcagcacctgcaaagctctgcaagcatccagcacaggccacactggccacctctctctcactctcttcactcccacagccgcagtttatataaagcaaaagcggaggagagcaacgcgccacacaagcaaagaacttggccccgcctcccgtctcttaccgcac

SEQ ID NO: 13269 - DNA, 1500 bp, Zea mays
tgggcaagagcgcgtattttatatagacctatagcgtcacaagccgccaggaagggaaaaaaaaatatagtgtgtgagtagcgaagaaaactctccccctctgaaaattcttgcattttgacgacatccgattcaatcattcagtagtacgtagtgtatttattttattgggatttagaaaaccagaccctgatatgatcctacgacggctggatggcagtttagtgttattcgactgtttcacgcgattactccctccgtttctttttatttgtcgctagatagtgttacactatccaacgacaaataaaaagaaacggaggaagtatttaggaagtgacgagtctagctaacccgattggttcaaatcctttcttcatcaatcaaccgttaaacggccgtgtcaatcggtgttggcgaaccgttaaaaccgtagcagccccagtggagtggggccttcttgtcgagttacacggtgttttatcctatcccgtggtcgctaacacgcacatgcctgggatgacagatgacactaacacgcacatgctcaattactactaacgcagaagtcaggtgcaattaaagagcagtaaatgcccaagtccctgttctgcttccaggacaggacaggaacactgtgatgaaacaacattcatcaggacggcacgcgaccgccgatgttcggcgacgacagctccgtaacatttcaccgctgaagcctgaagggagagggacctggcgtgcgctagcagctgctgatgacgccagccagacatggcaccacacgagacacggccgcccggttgaccggcgaagcagcccgggggtttccaagtcatcgccggtttccgcgggttcgccgtcgccagtcgccaactttggacagacagagacagtcagctcgggctctcgtctcgtccgtgctcgctctcgtctcgcatcgcacctgcgcgttgctggctcggcgtggacctggcgcggcgccggagccccgttagaaaccgcgcgtgtgcccgtgctatccatggtctcctgtaaatggtgtaatcttatcttatttaccgcatcaccattaacaatttaacacgagacgcacgacacccaagcctgtgatgccgacgtataccacaccatctaatccaaatccctgcattttttagtctctcagtcatcatcgactcatcgtttttttaatccattcacttttttttccaccttttcgtatacacgtcgctgtcgcctccatcgctgggctggcaagagaacgcgaggcgaagcagccgcggccgcccgcctatttatcgcgggctcgcggcacagggcagcggcagttccatacatacatacaccaaccgtgcgtgaaggaaggcctttgctcgccgccacatcacattggcaggcgaggcgagggagcgagcagcagggcaaggcatccacacccacacccaccggacactccctgagaagcgagaagcgagaagcgaagagcggccggccacc

SEQ ID NO: 13270 - DNA, 777 bp, Zea mays
cgtaaaggtctcgccacgggggtatgaaatctagcttcattgacacaaaagaaatagacaaagcaacgcatatactgggttttcgtccgggtgatcatatgatatatgctactgtcagcagggccaaaactaagtgggtgtttggtttctagctatggactaatttttattccttacattttatttcattttagtttctaaattgtcaaatacgaaaactaaaatagagttttagtttccatatcttttgtggtcaacaaaggagagatattacgcggcttgttcggttagattaggggtagactaagagaaattagattcctccttattcagttttgaatagaaatgaatttaattccccctcgttcctcacaatcccactcaaaccaaacatggccttaattagatatattgtgttgaatggaccaaaatattttcaaaactccattaatagctaaagctgtaagattttggtggggtctcattcaaaaccacaagtgcttttatcactatagaaactaagggtcaagttttctaattagaaaaaaactttcgttacatattcttgaacaggacggcccgggccatacattattatcattcattttgctagtacaaattagataggcccacacaccagaagactagctgacaacagaagttatggctaaatgatagctttattgttaaccatggtgcagtgaggtttgcttgacgtctaccagctgcgcataataacttggctcggaagaagaagaagatggacgctgatccaac

SEQ ID NO: 13271 - DNA, 713 bp, Zea mays
tctggagcttgacgggaagctgttcgtcaacacgcagcaggcccctacctggcgcgccaactgtcggcgtttcgagacccggggggtccctggaccgacgagtaaattgtcaccgcgtgccccagcccagatgggtcggcgcgagatggagcacaaaggggggaggaagccggagggagacgggcgtgagaggtggaaatcccgcggccctcgtgtttgtcctgcgcccaggtcgggtgcgcttgtagtagggggttacaagcgtccacgcgggaggggagcgagcggcctcacgtgagcgtctgtcccgtcctcttccccgcgcggccaaccctctgtaagagggccctagtccttccttttataggcgtaaggagaggatccaggtgtacaatggggggtgtagcagtgtgctaacgtgtctagcggaggagagctagcgccctaagtacatgccatcgtggcagccggagaggttttggcacccggttcgtgtggtgtcgtggccgtcggaggagcgctggagcctggcggaaggacagctgtcggggctgtcgagtccttgctgacgtcctcttgcttccgtaagggggctgagagccgccgtcgtcatagagcgtgcggggcgccatcattacttgtctggcggagcgagccagacgggacgccggtcttgttccccgtagcctgagttagcttggggtagggtaatg

SEQ ID NO: 13272 - DNA, 65 bp, Zea mays
ggagttcaagagagtgagatggaatggaaaaataaaagtaaaatgtaattattgcttcaccaagc

SEQ ID NO: 13273 - DNA, 1500 bp, Zea mays
tctctagcactgttctctaagtttagatacagttttagccatacaacccacataaataagttgtatgttgagaggttctagtgtataagatacaagacataaatatattatgttatatgaaggggtttattatgtgtatctaatgcttgaagaatcgcaacgtagtatctaagttgtacatgccctataaaatgactaaaagggacaaaactatatgcattccacattttgttccttatttatttcaattgcactaatggtgagagaatgataagagatatttttattttcttaggagtcatttaatacgttcggaatacttttagtctctttaattatataagatagggactaaactttagtttagactaaaatttagcctcttgactaacagatcctttttgtttactcgtggccggacttgcctagcccaggcagcatttcccggcgttcgatttcgaacatcaggttctgttgcctgacagcaactgcctgggagggtacgaaccaaaacgagtcctaaatccaaattctccgagaacacagaaggtttcccctatcagagtatgcgggaccagtaaatccgcacacacgttttttaaatgacgaggagctagctagcaaatgacccgagcagtcagtttcacgccggcaacatcctgccagctgcctggcggtccgaaacggttctcttatatcatttatttatatctctttttttttctttatccactattcccctaaatcacaactctcacaacgattctctctaaaatggtatattgtatttccaaaaaaaaaataaatttgtttttctacatatgtatttattatagtctaaaatggtgtgtgtatatatatatatatatatatatatatatatatatatatatatatatatatatatatatatattaattttgtgtttatttcataatttagagtataaaaatatttaggaagagaatattgaatacctagatataggatgtccgctacagatcatgtaaagtagaggctttataatgtagatattaatgtttataaaatgaggtttaaaatataggataagataggaataggatagaatagctgctgaaaacaacgagggcgagagaaagttgctgccgtttaggggtgggagaaagggtaccgctaagggcctaccttaaacacgcgtaggggcgtgggctcagcctagagatgtacagaaagcactgttgatgggtgttgcactgttgctgaagctggctggcctcctcgtcccgctgctgctatatataatctgtggcacggtgggcatggcaccagcatctcatatcctactgccggcgttccagagttcgagctgagcagttgcacacagctgctcgtgaagctagctagcgaagccacaggcccacagtgactttgctcccccacaccgtagcggccgtataaaccagctccaaccgatccatcgaaatcgaagcacagtacgtgagcccgtactagagacat

SEQ ID NO: 13274 - DNA, 1500 bp, Zea mays
tccatttttttaaaaaaatatagaatgtgacctgcaaattagatttttatttacgaatcatgcaatttttatatgtttaagttatataattttatttatgaaattattaattttatgtgttaaattgtgtgacttttaattgtgttcatacttagatgaatctatatttcaataagatatcagatatcgggttttattttagctaaaagttgtaaaagaaaaactgctgaggtgactataagcttcgtagataaaagctaatataaccgatgcagctcgcgagctgtgttgagagaatttcgtgacaggaggcctagtgcagttcgagaaggttcggctcgtagcaagcacccgaccgttggacgggcagaggctgtagtacgcgtgtactgactactgattaatccccaacccaagcagcccaacgctgctgctgctgctgatttgtgatcggcatgcaatttggcgttgccgccttgccggtgctcctgctacgcctacgactaacgaacggaaaggaaatgacggctcagattcgacgccgtgattttacccccaccactccgaatacagcattcactcatatttatgaatttatccagatttcctacctctcaccgggtggaacgttacaaattcgaactcatctgacaatgaggacaaattgtgtggtactacattgacagcctgcactgaatctactggcattttattcggatccgtaccattccgatttcctcgcgggtgatgatcacatctggacgttagaattcaaacaaattcaattgcaaataagagggaaaacaatctgtcaaagaaaacgaacatacaagactcgcaacgacgccacccgatgatttctctttcttgaagctaccgcaacactcgaacagaatgatgctcatgaacaacgacgcaccactgtccaccgaggtgacgccaccgctttaaaatccccgcagcctccgaacggatcgagctcgcccacctagaaatgacactctgactaacgacgagttttatcccatatagaggagtatgttaattgttaatggataagaacgtctacctatccgtaaaatatattcacatataccattataattatttaatagtctatattaactaaaattaaactcttttctagctattatttatatagctatcaagtcatgtaatcatgtgatttgttatatgtgaagttagaaaaaaaacactattttagttttcgtatttagcaattagagactaaaatgatataaaatgtaagagataaaaattagtctatataaatcaaacaccttcttaatattttaaatcttgatatttaaatgattgatatattgtaatttaagacttttctattgttacaagttacgagtaaaattttatgctcgctatcatatacatctaatcgtaaccttgccatccctaccccacctagcccccgccatactccgaccctagggtttccgtcctcttccgtaagcttccaaaaaa

SEQ ID NO: 13275 - DNA, 218 bp, Zea mays
cttgcatgcctgcagaaaaaagacattcgcaatcagagagaaagcacggatcacctatattttacatacaatactttttctttacgagtttagattttaaaaaaatagttttctaaggaacacgtgatgttttgatacataaatatactgaaacaaattaacaaaaacaggaacaattcctgatttagctgacaactgatctcaatcttgttgaacac

SEQ ID NO: 13276 - DNA, 425 bp, Zea mays
ggtataaacccttgctggcaatattctacccctgcttcgttcaagaagtgaagcaagttcttcatataaatgaagcatactatttgtgatgcactgcgcattctggggttagccgttcttgttgagtacttcctacatgctttcccagatcaacttctcaccttcgttaatatatgtcatacttattccaaaccacagcatcatttgtcaagctttctaaccattgagcagttactcgtttgtttagggcattgctgcagattccaacggcctattcttcaatttctcgcgtgcgtttagccccggctgcattcttgccagcaagatacaactttgaaggctatatcccccgtagctgctccagctcatcgctccaratctacagccggtcaccgctgttaaatctatcgccgtcttcagctctc

SEQ ID NO: 13277 - DNA, 142 bp, Zea mays
ggtgcatgcatatatgactacaaatttttttatgcatgtatcaccaacttttaacttttagacgtgttaatacaatctttttgtctcatcattattcttgcatattcagagacaacatgaatggcttccaaagggctgggtg

SEQ ID NO: 13278 - DNA, 253 bp, Zea mays
atcgccatcttctttgtggtgaattaatcacgtcctgttggatcagttgtactagccgcgacgcagtagtgcacgagaactgtatgtatggtgattttttttttgtttcttcatcaggtaggagctgaatcttctttcttctacctttacatacagtagtgcatgcgagaacaaggcgttgccacgcattggattaccgagtgctgtggcttcttaatgattgcggaccggtagacgtatttaaattgagatt

SEQ ID NO: 13279 - DNA, 304 bp, Zea mays
tcaccatcatgtcctctctctcctgcaccctcctcccgcctcgctgctctctctctcgtcttccttcatcgttcctcacctcactccatacaacgctcgaacacatcatcatcatcaaatatatatacacacactcaggtccatttcctcgttatcttctcgacacctacacaccgctctgctttcagccagatcgatcgccacatgcacattccctagcggcactagctatatctctgcagctagctagctatctagctgggtaataactaacgtgtacgtcgtacccagctataggacggca

SEQ ID NO: 13280 - DNA, 1214 bp, Zea mays
attctcgttatgttagttgcacgcagctataactatttggcatcatatatatatgtcgaatattagttatttggttgtgaaaaaaaggttggtatatatccctgtagattttgaatatacccagggccaggccacagcactaaaatctccaagctatacggtgcccggcttgctaacgttccggttatttattaaatcatgcatcatcagagccatgatcagtgactgattgggtagagtcagtaggtagctagcatatgcatgcatatgagcgatctcatcaactcgacctggctgcatttggagttggcgttgggaccaatgcagcatttgcctttgttccccctttaaaccaacaacacaacacatcacatgcccatgcatctggtagctatagctaaaaaaaacctggattacattttcctactacgcacccaacacatcaatggaccatgcagcatatgcagtccagatgaatgattgaacacgatttaattattttttttaaaaaaaatccccgtttgattatatttttggtgtgtgacaataatattgcaacaagaagtattggatgttacgagagttgcactaatccctttcttcattaattatattacgtgcacaatttaagaggtgtagacttgtttgcgttttgttccctttcttcagactcaacagataatgatctgatgatggcagctatgtatcctagctaattcatcatttatatatgtttggatccggctaatatataggtgcatatatatatatataatatccctaagcaatgaactttagccaattgtgtttggttaattgactaacaactagacaagagttcagttcagtagatagatgaaccaatataaaacacagccatgcatgacgactaattagttactgatagccggttgctgttggctcatggctgtcacggacactgctgctaatgaagaaatctgtacgacatagaagctatataagcagtgaccgtcttccccacaagcacaacaagcagaagcagaagcagaagctagcagctagtagacgagcgacgagtagctagctagctagctatctagagagctcatcatatcgctgctcgctctcatccaccattatagagaagagcagatcgagctgcagctggcagaggccgagttgttgctagctagctcctgcttgctaaatttgcatcgtatccgatccattcc

SEQ ID NO: 13281 - DNA, 241 bp, Zea mays
ggtaaagattctcatttttttcgcaaacaaatgtttagtttttgcaaacttttatttataattatgtgggtggtgaaaattagtaatctgaacagtgcttactgaaaggagactttgtctaacctcatttgagtcctttctgcagctaacgtttgcagttctactaagcatttatattcatacaaaatattattcagtagattgatattctttgcttactattcgatctaactatcataaa

SEQ ID NO: 13282 - DNA, 1226 bp, Zea mays
gtagcttcactatcgcgtttctttttcccacatgactgtagtatcgatctctatttcatagtacacgtttttataatgtttgcttttatatggtgtaatgttcttatgcatgtatatctttgtttatttgtgcctgtttgtattcgctgcccgtcgcgaatagattgcgatatgttcctgagcttcgaggaatcgatggtcaagcttcgacgtgagcttcgaggaatcgacggtctagcttcgacgaccaagtgatcaagctcttcgagttctacaaggctgaagaccctgagcatctgtttggtgaaggcaagtgtcctctgacctattatgtcccatttactttataattcatcaacccgcataccatgatcaacctaaggattgactagctttgtatttaccttgtccttgattacctttttgggttattatggttagcttcatgctattgctttactttaatcaataaacatgatgtgaacacttatgatacgatgttgtctctatgattatgatgttggactgacgatactttagggggctcgagcggtttctcgagtgcctctccgtaaggacctgttcgttggatgaccgtccgggaaaacagtgcaaccatgagggtagaatgggacgcccttagctgaataattagaggaactggggtgtagttcgcttcgtcgtcgtgccgttaatggtgctcggtgtatgcggctcgctctgccaaggttggttcgccccttgggaaggagtgcggtgcatttaggaaacctaacgggcgactacagcctcagggaatctttgtaaaggcttcttagtgaatccctggccattcacctcgggagtgaataagggtcttgcaagcccgggctagagagggaatcacggcttgtgggtaaagtgcgcaacctctgcagagtgttatgaaactgatattcagccgtgctcgcggttatgagcggccaagggagctccattgattagagatactggatcagagatgtttggattacaggtggtgacaaggatgatgtttatgactatggtaatggtaagtggtattctttccgtttggaaagggtactttgggttaataacttgggttaatgctaaaacctggctttctactagtaataataacctgatcaactaaaagcaactgcttgacttaactccacataaaactagtccacctcagccaaaccgggcatttgctgagtacgttg

SEQ ID NO: 13283 - DNA, 1002 bp, Zea mays
tgaatcttagattttatgcaatattagttttttcgatataaatggtttttttgtctcccatagattttcctgctggctccgccactactcctcccgtagtcccgtgctaaccattaggtaaaatccggccaacttctgtgcttggttccacccgagagaaaggagccgggacaagctggcattcacagcttcatgcggctcccacccttgtcagagcacaaaatccggggatctggcccgtgaagctggtcgtgctcgtgggcacgctgtctggctgtggctgattgaaagctgagaagcagcttgtgaagtctggtctcgaatccgtgccattgccaaacgtcccgtgcaacagcagagacgtccggtttgtactccaaaatccactcttcgcttcgcctgcagtcggcaccgccgttcaagcaacggccaccgcacctcttgaaccatgaaccctaagtatccttatccacggtgagctctgaaatccacgtcgcctcacgtacagtactccccatagatttcagacggagctggaagaaaaagaaagcctagccaccgagacgtgcaacgggacacatccacgacacgaacgccgcgacgggactgggcaatgcaggtggtgtgggagtatttatcagcctcgccgtgtcttctttttatgttccagcacgtaatgtagggcgcgtagaatctagactatcaaatcgcgaggggcgagcgacgacgacggtgcggtgcagctttctacaggactagtcgttttcacgtcgtagcagagcacgctcgcttggagcagccgacaaacaccaagcgctagtagactaggactacagtgcagtgcgtctcgcaagtccacgggcctcgcattgcattgcaaaaaaaaaaaaaaaaaacagttgccgctatataacaggatccagcgcacggcaaggcggcaggcaacagcaacacggagtcaaggagcacgagttaggttggcaaccctcgagagtcgagagc

SEQ ID NO: 13284 - DNA, 450 bp, Zea mays
aagagagataaaatagatacataggctaaaatggtggggttcatatgtcaaccacgacgcgtttcgacctaactaagaccggaacaacaattaaggaccagactgacacactttaaaagtttatggaccgagttaacatataacgtcatataagttgaagtaatgaaaatgtattttactcttaggatatatcatcacaggagcggtacaccgtcgggttttttttttggaggatgggggacaactatcacgagggatacaatacaacttagtaaggccgcgaggtaacaaactaacaagtggcccatcgaaacagtaaattgtttcccggcccgctcggccgaacaagtgacgtccccattctaaatctaagcccacttctgactaaccacaacgcaacgaacaaagcgacaacatgagaggcagacgaaggccgccttccacttttcg

SEQ ID NO: 13285 - DNA, 70 bp, Zea mays
aatgatataaaatctaccttctttcgtccggaatagtgtcgaggttatctccgctccttgtgaaggaaag

SEQ ID NO: 13286 - DNA, 798 bp, Zea mays
tctagaggatccttttgtgggcttcaccactatttcgtttcttgatactgtcagggattcatcactacatcaatgctgagcaggccgaaagtattactacattccgaaatgacggtgtatgcccttataatgagcaaagcattctgtaataatattgacaaatcacatacttcaaaagtacttaaaatttatggacatttgctttactgatggaactaaaagttttaatgacctctagtagaggttgagtgttgtcaaagcttgtacgctgtatttttaattaacttatcccaaagggaagtattccttcctcttgttttttcctgagcggaagctctgaaacgaaatggcccaacttccgcctagcgaagcccagcacggcatcgaacggcagcgggcctcatgtttttttgtgggcgcaagctctgaaacgaaaatggtgaactgctgcccagtgaagcccagcacgacatcgaaaaaccacgggcatcctgttctttttgggcgtgggctctgaaacgaaatggcccaacttccgcccagcgagctaaacccacaacgcatcgaacaacgacggccagcttcccaaggcaaggaccatacgtgccacctgcctacctcatcaaaaatgacgaaaaaaaatgaacgcgttgaaacaccgaaaggcaagccggcagcaccaaacttttctcctaatttatcctccaaaaaaacaaaaaaggggagggaaaaaattctcgtcttcttccccgtgcttgccagcacccgaggtcggcgagctctccgaaagcggcggcg

SEQ ID NO: 13287 - DNA, 1500 bp, Zea mays
gttttgtcatctacatgtacttactctcgtagcagaatgactgcatgagctgacaattgcactcctttaccctcttagactctcacgctgtctccggtaagggcagggtgatgcggaactatagatatagatgacaccttctctatcgattcttcatcctaaatccttatgtttggtcccttttcagcctttctccaaccattttctctattcagctcttcttattttctctattcagctcttcttttaccatttatttgagctatttgaattttttgtacattagtttttggagctcttctttcaccatttaattgagctatttgcgtcaatgcgtgtggggttgagcaatgcatccacccatcgattccaggtttcgtctttttctgcgcctgcctctgcggcagcacaggcacactgccctggcagcaccagctagagcagtgcagcaccgctcaaaaagtcgatttcacgcagcgcacaggcacactgcactgcacttcgtacttcctcagtcccagttttcctatcgtttgacttttttgacactatatttgaccgacttgtcttgttcaaaaagaatttataattactaactattttcattatgatttggtttatcatataatttattttaactatagattattttttctatatttttataaatattttgaataaaacgagccgatcaaatttggtgtcaagaagatcaaagacatgtaagttgagacagatagtacggtactagcttcaggtgacttttagacttttaaatggtaattataagtatgaaacttctctaagataatattgtagctttattttatccatttctatttttttattctctatctcttaaagaagacatttttttttactcttgccaactcccatgacacaagaagcaaggaagttctaaataagctctcgatgctgccaccgtcccatatctctctcttgcatcgccgctggtcatccttccgtcgtacgccaccatgcactgggcgtataccgctatcttattgatgaacttgattcttcttcttcatgtaaatgaacaagtttattcgctttatgaataaacatatttgctatcagattagaattatatgagatatatgtttatgtctcgttctctttaagtcatgaagtacctttttaaaatttaatgattttttacttttgttaaaaattaaataaatatttttcatattttaaatcaaaacccgtccttttaattggtaaaaaataagaaataaaatataaacaaaatccatttcaatttttagagaataataatctggtagagtggtaggaagaaactataattgcaaaactctcgggcacagttccgatcgggtcccatcccagcgtccccctggctgctgccaccggtataaaaatgctcgagcacagttccactcggtcccccaaagccaaagggcaaaggcccaaaaacccagccggccagagccagtcccccaccccccagcagcc

SEQ ID NO: 13288 - DNA, 199 bp, Zea mays
ctccctcctcctcctctctctctctctctctctagcacacagcagtacagttgatcatattatctgagaagtactatactagtagaagcttgtagcagctagctacagccaatagtgtaagctccaactccaacacagacaaatatacttgcgccagtagtgagtgattctagtacatcctcggatcgagcttggcagc

SEQ ID NO: 13289 - DNA, 412 bp, Zea mays
ccaacattaaacattagtgcaacgtgaggattacaatatcgttcacactatttgtgacgtgatatctcaacacaatgacatatactgctacgcggatttagtctcagcaaagggaaatttttaaaaatgacaaaaataaaataaatcagtttaattgcccatacaataacttaattcaaatgtatccttgcttgtcgaaataagctatttttcaaaaaaaaaacacagatgaaatcgtctgaaccgaatcaatacatggtccaaattttaatcctacttccccgctcaaaagaaagcccaatttggtcagtttaaattgtcaaaattttaatcctagggcacccatctctaaaaagagaagaaaacttcccaaacccctttggtcggcctctcagttctcagcaccgcggcc

SEQ ID NO: 13290 - DNA, 419 bp, Zea mays
gtttagtatttacagactaaaatagataaattaaaaattagtccatataaacaaacacctctaaactttatttattttttactttagctcctatgacagttgagctttattatacttttagcagaagctgtgccctccgtctccctctcgagctctcgcactcctccgtcgtcctccaaaccctaggccagaccagagctgaagtcgagcggaagtccaaggtgagttctctctcccctaatccgcccgacgccacctctctcttcccacctcaccgtggcccgatccgcgcaggcaccgccgcgaccccccatcctccgcacgacctggatctgacgcgcctccccctgccgccgtccgcctcacacctcctcgcggcggccgccgtgctcgggctcctaggcggcctcctactctac

SEQ ID NO: 13291 - DNA, 976 bp, Zea mays
tggcgcgggcgaggccttccagcgcgctgcgcgggcgtggcccagcgtccagcggccctgacgccaatgcttgcacccgtgcgaagccccgtagccagcaattccattgtttgcatgaatgaaatcatcgagacgattgacacataataaatccttacagacttgctgtagattcatagtgctagatgtggacaataaagcgtcgctgtatgcttctgcttttcttttttggtgtgtgtagccacatcctttgttcctgcccggcgccatcccacttagttgttcttttgcattatgattgaaagccttcatgcttcctcggtcaatcaccggtgcgcactgggagcatcgccggaaaaaaaattcttcggctaagagtaacttctttctccttttcttctctgatctcgcgagcagtgctgataacgtgttgtaatctacttagcggtaacgagattgagagagacaaaatgacagaactattgtctttattgcagagtgtcatgtatttatacaggggatacaaagtctcccaaggggtgtgtcccttgggagtaactgccagttgatcacaggacaatattttgtaacaaaacgtacacatcgtcaaaatagcgaggcatgaaactggccttggccatggacgcgtgaagcgcgccatgcgttggatatgtggtcaataagtatatacaatacaatgtttaacagagctgatagtactgctttggcacatttttgtccacgcttcatgagagacaaaaacacctgcacttaaattcacatgctgcactgaaggcccgatcactgaggagcgaactgccgtaactcccttctatatatacccccagtccctgtttcagttttcgtcaagctagcagcaccaagttgtcgatcacttgcctgctcttgagctcgatcaagctatcatcagctacagcttccgatcccaactgcaactgtagcagcgacaactgcc

SEQ ID NO: 13292 - DNA, 847 bp, Zea mays
aaaacacaataaaacctataagtcaaggttcagacacatggatggctgttttccatgcactcctatttaaggctaaatcctttgatatatttcaacctttcaaaaaatagcgacattgagtaaagctaatatttgtgaattgtgatggtctaggcagcctagtagggtagaataaatatcatgagaggtccacccgtttagccatataggtggtacacaaactttatgcgaagtgattatctaattctaatctaatcataagtgatgcatctcggggacaaaatgccaagcttctaagcatgtacttagagatgacagcaacatatgaaaaaaaatgttcagcagattttgatatttctgtccttactgaactagcagaaggaagtaagattaagacataacttggatatgagtaaagtttatcagaaaatgggtgttcagggagatgtctcagcctctctcttattttttccatcctcttgatgaaatggcaactaccactcctgcatagtccctagtccgggagatgaatgtaaagtttatcaactaataaacaatcaacaagaaaattataagtaatttggagtgttacatcgtttgtcatttaaccactctggaaggaatctgaagcagaattcagagtggaacaaccatgattaaaataattgaacttgtagtccactagggagaccaagataaattaattattcaatatactgagttactcacagcataagctagtctctataaatagcagagaatgatgaccccatgattcatagcattcacatcaaagagtaagaataagagtataagactaacaacagcaccaagaagaagacccaag

SEQ ID NO: 13293 - DNA, 1500 bp, Zea mays
gcatcctggatgcatagatttttttttttgtcgcaacacacggacaatatactagtagtagtttaaaggggacgacgacataaaaatcagatttccagctttcgtttctttgagttttagtgatccatgaaagtagtgtctaatgttccgatttatttttcgatgtcagttgttggatctttgtctactatgctataaaataggtcaatgctgcttaaaatttggtagctatatgatgtgaagtcaatacagaaagtccgtgtttcagacccctgaccaacggactacgatttgcatgcacatctatattctttgcaggcaagcatgatttttattgatggccactcgacgtctaagcaaagccgaaaatgacccacaagcctatcaattgcggcagacctgctttcccagcggatcctggtggtcgtcccctcgtgaacctggacacttcgcctgattcactgggacgtgaacaagtgcaggttcatcgcggccggagcggacgaggacgaggacgaggaggagcacagcccgcgttccggtgcagtatcagtagcagcagcggcactaccactaccacctcaccgaacaccctagtagggtcatcagatttgcagtcccatgagtaaattgtcattatagtactattttgatgaagtactacgtttcatataattactttgatgaagtctctgtcctcacctaccgccacactacccacttttccactgggcctgggcggttagtcgccccgtcgccatcgtttccgatgccaatcctgccggcccggcatctagcgccgtgcagctggagctggaggaggaggacccttctgccgcgtgcgccggcatcgcgcgacgcgagccgcgaggaatcaggacgggaataaatttttttgcagccccatcacataacagcgtggtcaaacgggtggcaatggcatccataaagaacgcaaatcggatacatgctgatcacaaatcatgtttttttcactctggttatatgaaaggctgtagagatctagatttacagccggtctgcacaattgttttttttacagtgcagctcaggcgtgttcgtcgactacctagtaggctttggtgggactaatcaccaattcaccatatcctctctcgtttttttaaaaaaaaaaaacactgtttctctaatctgaaaacgaaaattttcagagaaattcaagggacggaacgcgtgagagggaatgctatattttgttcaaacgcaacatatatactgccagcataaattgtcctagcgtgaaaattggacaaatttcacagttcgccaatcgaacgcaacgacaaccaccagtccgtcgccttgcatcgacatcgatcgataacctacgcacggaaccagctgctaggagtgttttcctttcctatatatagtgatgtttgattgtcagctccacaaatcgataggctaaggaagctccatcgatcctgcgttattttgccggtaattgattgatag

SEQ ID NO: 13294 - DNA, 73 bp, Zea mays
agagaacctggccttcaagccaggtgaggatgctgatgactttgctctccgcctcaacactctgttgcagaag

SEQ ID NO: 13295 - DNA, 1181 bp, Zea mays
tcagacgaaaggctgctcgtctgagcaggagaggaaggaacagttggagctcttgctgccgactgagtgtggggagaggcgcgggaaggagatgagcaagagatgtttaggctacaggatagtttggctttgataccaattgtaagtagagggactctaactctcatcaagaggatgacactatgagttggggcaattttctgtttatttcctcaaacactacacaatgccatacccttagaggggttggggacacatatttatagccctaggggctgcactaccacaccttctcacacacactacacaacaggattgtcctctagatgctaaagagactacagaggacagtcaaaagcgactgttgtcctttagatgctaaagcgactacagaggacagtcaaaaagcgactgttgtcctctagatgctaaagggactacagaggacagtcaagctgtcctctagatgctaaaggactacagaggacagtcaaaagcaggctgtcctctagatgctcaagacttattccatcagtagggtttagggttttagaaatttagcagtatgacaattgtagtcattcgcgcgtggggaggggggtgacgtacgaagggagaaactcccacattatagtagtagagaatagagaattggcttgaagtcattaaatgtgattatagtactataaatcatagtcactaaggtaatgactgaatcattagtggaaaattttgatgctttctgactttggggttgatcagcagtttataaatcttccctgattgcatcccagcactgtctttaggacttccagggtaagtggcttggatgaaagataagcaaataatcaaaatttgtgcttgatgccttcgcagttctccaatttgttgttggaacctgcagtgcctgtgaccaacaaaaatcatttcatatttctcttgttgatggaaaaactagatggaaagaatgaaatgctggcatgtctttcttgtcattttatacattcagaaagatatttttgttccaaataatcttgaaataacagagttccatacaaatctcacggctttacaaaatgttggtacttacgtgcattcttcacttcagataactgatattattattttgtcatggcttgccatttaattggagaaaaaaacgtattcactttcatgatttc

SEQ ID NO: 13296 - DNA, 89 bp, Zea mays
ggtgcggagagaaagactataagagcgacctgggtcccttgaggatgccgtcaagaaaccgcgtggagaggagggcgatgagatgaggg

SEQ ID NO: 13297 - DNA, 200 bp, Zea mays
  unsure (1)..(200): unsure at all n locations
gctttgaggattggaatggattgatccatgaacacttcattcttgaatcttgacaaagcacatgatntgtagaagcatgagagatggagtcatcattgtgtgtctatggcagtaaagtacttagaaaaatgacctattcctaaatccaaaaacttaatctattttatccaagttaagcctcagtgcatgtgacaaacagt

SEQ ID NO: 13298 - DNA, 357 bp, Zea mays
gttcttacctatgtactcgtgttggtgcgttcgccccgtagcagccgtcgggcttctctgccttgtacttgcgatcgagtccagacctgcggagatagatctactagtcgaccgatccggatccttcccttccgtctcacggcaagtatcttccctcttcccctctgctcctgccaggctgccacacctccgccagcgctagggttttcattttcactcgctgttgctggtggttgttacccttcctctctctctcagccgtcaccctcggagccgcagtcgccgtagcagatcttctctctaatcctatcggtcaacagctgcttgctcgggacgggaaccggaggtggggttgcg

SEQ ID NO: 13299 - DNA, 310 bp, Zea mays
gttcgatgataagcttgctgggataggtctgatggcacaagggtggtgaaggatatgtcactaattctagtgatcttgttgttgattaccaggtagctccaaatgtggctagggcaggcattgttggtgaaacaattatggaactaagatttatctaggtgatactttgcttaggaccgaggagctggacgaggagagtctggatgtcgaccattgatgatgatcctttgtggacactttctgtagatgacatcattggaccaacaatagctcctggttatgctgcacacaacatccataacatctgttc

SEQ ID NO: 13300 - DNA, 538 bp, Zea mays
agtctattggatacaattttcttttaatattagctaaatttacttttacaaaaccatatacatagtctcttggagttgctcttatattgtctgtttagattgtgcaagattttgattggatttagtgtaaggagtttgttgatgctgcttaacatttgacagcaatattatgattgtaacttatataaatcaactaaggtttggaactgctatgccaggtctttgtcaattatgaatagaataacattaattgctttctttttgggcaaacattttttctataaaaattaatccctctctgtttagtttactcggtgccattttgattttgaaggtggactgcagggataaactcaaagaggaagaaactgaagagtgctgtcatggtcactatacatatggggatttgggtgacaggtgcttcgggactataggccgatgcttgacagagaccctcgtccttgtttcgcaggctggtggttctgtagcatacctgatattcattggccaaaatctccattccacattcagccagctg

SEQ ID NO: 13301 - DNA, 1500 bp, Zea mays
atgcaagcatcaggcactccaagtgaccaagtcagatggtgcggatctgccaccgtgctggtatgctgtggccaagtagtttatctgtaatcacaatcgagtgagttcagtgatcaccacaatgccatagattctgagaaaagaaaagcaatgtacttcacttgtacagcgaacgagtttccagaacggacaaccaaaggcaccgaaacaggaaggcagctgaacattttttatacattgaggccgtttataaaatttgaatttcaaatttgaaaactttacacgaatttttaatgataaaatgatttcaaataaaaaaatttgttaattataaagtttcattacatttcaagaactacaacttaatttaaattaatttactgttttaaaatgtgatttttaaattgtctttgtctattgttaaaaaaaagcactcgataaagaagttctttgccgagtgtcaaaaaatactactgagtgtcaaaaataaaacactcagcaaatagcttcttcgccgagtgtgagtgttttattttaccgaggatttttttcgtttctttaccgagtgctcgaaaaaacacttgacaaatatttggcactcggcaaagaaccaaatttctacttcttccatcacaacaccgccactggcgggagctcaagttctcgggggacatatcgttactgtaacactcgatcagatattcagatctaccctctacaatctttatctttttgtgctgcccatatatagatctgctttacctgttagcacgcaaaggcacctgaacgtacggtacatctcaagaagaagaagaagaagcaaatgtttctatgcccggcggaaccatatcgaattcctagtcccgtgtctcactgaagattgcaccagaatctagctttaattttgatgaaacaaagcccaacattacatggcgcgcgagttatgttcttgaaccccgacagaagccacctgctacaacctctttggcgccaactccgtacgaaatccaagtattcaatccaacccgacactgccatagatgggtctttcggtacgtgttgctcaaccccggccccgttgctaaaggatcgcatgcacgcatcatgaacgccgccatgggcgacccgacgcacctaccgtccccgcgcgatctttctaattttcttcgccctggagacagagagcgtgcgcgcatgcatgcatggttgctcgatccaagcaagaaccctgacgctctttaatttgcctttgataagatgaggggcggatcggggagctttcgctttccgctgccgtgctgtaatcctcggcggcaaggcaagcatattacccacctgcataaataggcgccgatggaccgccgtctcgtcttcatcgaggcacaccgcatcagtgtctggctcacctcacctgcagcaggcctcgtctcggtcatccagcgcattgctctcaatcgctgcagcgcatccagtccaaacacacaccggtcgaatcgagca

SEQ ID NO: 13302 - DNA, 94 bp, Zea mays
gaattttctgggtgagtagtgcaggtgtgtgtggggagcctgttgtgggctttgtactttggtccattttggacctttttcttctcttaatata

SEQ ID NO: 13303 - DNA, 731 bp, Zea mays
cgtgttcgagagtagctaaagttaatttaaaacaaaactcaagaaataaaggaggcgcagctcctggataaatagagaggggacgcagcctctaggggcggccaaccctaggtcgtccattatgggccgcagttgggctggtcgtctattcttccgggccttcgttctttaacagcatgatgtagttcaattctcttgcacgggcccgagtcactggcccaggtggaagaggtggcgcctggacttgtgaagatggtgcctgggctggagaaggtgctgctggtgtagatgtgctcgtgttggtgttgatgtcctcatcacagaccatatcgtgctaatggataatggtacaaatgttttttcctaaattgctaggacgctaaattatttttagtttaaaatatatagaaatatagattaatcataactcgatccaatccttatattttatactttaaaatttggaggccatcgtcaccccactcgtgcgtgagcggtgagccgcggccgccccgcgaagagaggtgacgcggcgagcacacggccatagaggttactgctctcctgggctgtgaggctgtgaggctgtgaccaaacgctctacgctcccacttcccaccaactcccaaatcctccctgaaaataagaatacgagggtgagcgatcgagcggtcgagggggttgtgcttgtgcgtcagatcaaccgactggtggcgaggctgcgggaggag

SEQ ID NO: 13304 - DNA, 403 bp, Zea mays
aacgtcgtctcctcccccaatcgagttattccacaccctctcatcgaaagatcgggcaatcacccaacgggtgcacatcaggagttctgaatacacgaagacaacgcagatttgcgcgtgttcgagagtagctaaggctaacgtaaaacaaaactcaggaaataaaggaggcgcagctcctgaataaatagagagggggcgcagcccctaggggcggccaaccctaggtcgtccattatgggccgcaattgggctggtcgtctattcttccgggccttcgttctttaacaacatgatgtagttcaattctcttgcacgggcccgagtcactggcccaggtggaaggggtggcgcctgggctggagaaggtgctgctggtgtagatgtgctcgtgttggtgttg

SEQ ID NO: 13305 - DNA, 926 bp, Zea mays
gctggttcaagttttggccttggtatcttactggttcaatgtggcactgctagctatgtatgtgaaagtctttaaagatggaagaagaagttggcatggatggttaggggagacactaaagttaaatrgtgctaaagtttatctaaagctagcaatatcatctacagttatgacctggtaagcttgatgtggggcaccatgtgaaaaacatgtatttcaataagtcttgaattcgaactttatggtttggcaaagtagtaatgtctaccttttcctactttctgcatggaactggtaatttgattttcaagataactcagcttggagtattgggcatttgagatggtggttcctagcgggatttctttcagatccaatactagaaaattcagttttgtcagtcaggtaagtaagtgaaatttgaattgccttctccctttcagtaatgcgaaattctattaaactcatcgatcttttagatctgatgttgttctgtaacatgactgatcactgtgtggttgcattagttttctttctcatgtcttgagatagttgtgtcttgtgcttcaatcatgcatctctactacctattaagaggcaagagagggcgtccacaagcgacaccatacaataatcaatcatattagcagacatgattaattatattaaacttcaattcttgtctcattggtgctctcgtttaagtgtagtagtccttgttaaatatattgccatattagtagacatgactgcatcctaatcttctttagcaaattcattcgcagtaagcttgtcgtcttatgcatgtttatatttgagcaaatcataatttacttggagcaacatatttaccaggacttaagaagtgagcactacgactttgcaaaagtggtgataatgatatatcgtagattgtcagtgatgca

SEQ ID NO: 13306 - DNA, 466 bp, Zea mays
ctagctaagctatctaggctaagacagagtatacaatgtcaagcacgcataagagaggtttttcggtgacagagacacgcgcacgcatgacatgacgcatagatgaagctccgaatgcaccgggaccggttcaaaccttccaactcaatctccctgctagcaccagcttgatgtacttctggttcccatatccgtgccatgccatgacgtccaactccaagcttgcagagatgttacacaactatatatgtgctgtgtttgctctagtgtttagccaacaaaaacgaaagctacagagcccaaaacccaagagagagctagctcaaaaccacgtgcacacgtacaaacctctattcaactctcgaccaagctattattagcaaagcacaccaagcggcagctagcagctaacagctaactaccttcatttgtacgtgtgcatgcacacatccggtgccacgacatc

SEQ ID NO: 13307 - DNA, 524 bp, Zea mays
cgtggttgtgggttcggcaacactcccgtgctgggaactggttggttcgcgagagatcttagccaccattgatttttagcatacaacttggaatcttgttctgcaacgtgctacttgttttgtggcctcgattctccatttctactcgttggttcgaccctgactgcatgtgaatgtgggctgaactttacataatttctggtgcataacactaatctcgtgatggcatgtcgtttcatgctatgtggctcgaatattgttgctggtaatcttagtcccatcttgctgcttaaagcgatggcggttgtcttggtctctgattttatttttctatgtttgtgggttgagcatgatcctatggagattatagagactgttaaggtatgtattaaacaggcagttggcagagatgataaacaaatgtcgttactaatttgaaggccattgggatcacaaattatagggaaaccattgttatatggagtaaatccactagctatccactttgtaatgccattgtgtgg

SEQ ID NO: 13308 - DNA, 127 bp, Zea mays
gacaaggccttcgcagttagactccggtcgggacagccgcagtcagtagcaggtgcataacatagccaaccagcaccccaccggcgaggctcctcgccgtcaagattatccccccagggccgcggca

SEQ ID NO: 13309 - DNA, 649 bp, Zea mays
tctctgagaggttttggagctcggagaggggggctgctgctggatcgggggtgctagggtttggggtggaggggtgacccgtggccgtagccgtggccgggtggggaagaacaggtcaccgttgaaatggttcgaagctcgaactgatttgaattttgcggtcgggactcacgatgcatgtgatcttcgcaagctggcttgggctgggctgtccatctagaagggcaatccttagtgggctttagttcgactccaagcctgctcgcccactcgttaataaccgttgttcaaattttctcccccgttcaccccgccgcgtgctcgcttctctcttctctcttctctctcagccgagctccctctctccgcgattggcgacgactgaggagcgggcagaattcaaaaaaaaaaaaaaaaaagagtgggcgaccgccgccgccgcccaacgccaggtgcccgggccgctttcgccagcaacgagcacccaccaggtacgcccgccgttttttctccccttactactgtgcgaaaccgagcatccaaattccaaaccctaacggctagttgtaatcggatctgatctatctacaagcatcttctgccgactaacttcgattttgcaaagattattgcgcctgctgggtacgag

SEQ ID NO: 13310 - DNA, 649 bp, Zea mays
tctcgtacccagcaggcgcaataatctttgcaaaatcgaagttagtcggcagaagatgcttgtagatagatcagatccgattacaactagccgttagggtttggaatttggatgctcggtttcgcacagtagtaaggggagaaaaaacggcgggcgtacctggtgggtgctcgttgctggcgaaagcggcccgggcacctggcgttgggcggcggcggcggtcgcccactcttttttttttttttttttgaattctgcccgctcctcagtcgtcgccaatcgcggagagagggagctcggctgagagagaagagagaagagagaagcgagcacgcggcggggtgaacgggggagaaaatttgaacaacggttattaacgagtgggcgagcaggcttggagtcgaactaaagcccactaaggattgcccttctagatggacagcccagcccaagccagcttgcgaagatcacatgcatcgtgagtcccgaccgcaaaattcaaatcagttcgagcttcgaaccatttcaacggtgacctgttcttccccacccggccacggctacggccacgggtcacccctccaccccaaaccctagcacccccgatccagcagcagcccccctctccgagctccaaaacctctcagag

SEQ ID NO: 13311 - DNA, 1234 bp, Zea mays
ctgagcattaaacaaaagccagtaactagtgggtaggtacaagttttctattttatcacagtaaatagtagaaaaaaatatacgttttctcaaacaatttgtcaggaataatgtgggggcagacacgaatgacacatgaccatcgtaccttggcttccaagaagctccacacatgacagtcgcagttaaagttacagactccacatagtacttgacatgcatttctcgtttaaccttttcaatgtgaaatgagaggtcatatatagtaaatggcaaagttaaacatgaaaccgaagaaaaataccctagatgtgtgcactaatggtcttaaaaggaaatcttataattctccatcacgtgaacttgtgcacaagtttgcaagaaggattgcacaaagaatatcacgtactacacacacatagcacacacgatgacgatcagctggcttatcgtgcagactgtgggggctgtccagttggagcagctagcacagttttgtgcaggaagtgcaaggggaggaatttattgtggcttctcctaataacaatgaattgagatcaggaagtgaggcagagagacacgtgatctcagcaaattagtttctggcctacaccctgactcctgtctctgggcctgcctgtccgcgccaccctttccctgctgcgaccctgcatcatcctatcaatccatctatagcaggctatagcggcctctctgcgtacgtactacacttcacccacacaaaaaattaaaactgagaagggaccagaaaatggagaagagacacgatcttctcctctcagttcaaatatatatggtactaggagtacgtggtagctcttgtccttgtcaaggtgtaggtaaaagatcgaaggagtactagtagaataataattatttcacctttctggtagagaggtcctaatctttttaatttctccctcccttctcctcggccttccctctcctcggtcacagagagaggttgccgagataagatctgcactgccttcttttgcttgtcactttcacaaaagagaggccggccggctgcatgctcccaggccaccagcgcacgcaggagctactattaagcagcttggcttggtgtggttctacttctatctgcctgcgctgcgcctctcctcctgcggacggagtccttgtgcttgtggacggttcccaagtcccaacttccttccgcccatatggccactaaatctttttcatcgac

SEQ ID NO: 13312 - DNA, 717 bp, Zea mays
gaaatatgaaaaaaccgttgatgacctagggactggagaacagtaatggcatgttggcaaagtaataagctccgttagaaaccactccctcttttattcattgtttataaaaacacacacactaggaaatcactccctctccttttcagtgtttatcacaaacacatgctaggaaatcactccccttagtcttcagcgtttatcacaaacactcatttggaaaatcactctgtctcccttcttttgattgatgtggctctctcaaccatcaccattttctcatatatatagctgttacgcccatgatatcctcctaattactgtaggcataagtcatatgctgggctattattctcctttactaggtgaaaatctgttaatactaaagactgcttctagacacaataaacctggatgcatggacacataggattatagctaacaagctcttgaaccacatgcatgttatagtcgtcacttatataatacatcttttttatttgtttgtacatttatatgttcttgcttttctctagcagtatatcaatgcaaattaatggatatttggtcatttgattctaaaggtatgccaattctacaggttgcttcacaaaacttacaacatccaggatacaactaataaggattccttcatctttatctggattttgaggaggttgctgagagcccatccagcagggtgtctcagacatacta

SEQ ID NO: 13313 - DNA, 52 bp, Zea mays
tggtatatagctaggcagctactagctcgctgcacctccccaaacctctcga

SEQ ID NO: 13314 - DNA, 937 bp, Zea mays
ttgcatgcctgcagtttactgtttttgaaggtgctcagtttcccccacccccatatttctcaaacatgcaggagaagttgaccttagcaaacaagctactcgttaagtaaatgtgtgttcaaccatacaaattattttgttctcttgtaggactatttgcttggatgatttagcatagtagctattcattccttttctcaaacacgccattttttactgcatagtgcatatgcatagtgagtgcatttgtatgtctttagtatttccaatgttaattgttaagcgaaagaacatctagttgagttggttaggtggtttgagtagcactccttaggtcctgagttcgaatcctagcgggagcgaatttcaggctaaggttaaaaaaaagtcactcgttggctcctctagttgtgtgcacacgagatggactgacttatagggggcggatcctcacgtaggggctgtaagggctcaaaacactagtaaagatttgggctatagggggcggaccctcatgttgcatggggcccagcttttgacctttcttggccgaggctctaattgagctttttcttaatataataccatgagggtggtctttctcttactgtccgagttttttttcgggggctccgattgagcttcttcttaatataataccgtggagtggtctttctcctaacagccgagtttttttcccaattccaatgttaatatattcaaatcaggtctaccatggtataattgaaagcagttgtattaaactatggtgtgggccttttgagtcagtcttccatgtttctgagaaaccatgcaaccttttctttttgttttatttgcccatcaaactgtacccttcattcctgatctataagaatgactgcaagatgcttacttagtgtactcatgtactttgcagaatcctgtatctctaaac

SEQ ID NO: 13315 - DNA, 1500 bp, Zea mays
atgcgtggtgattgttctattgctatggtttatttgctcccacctgttgctatagtacgtggattgtctttcaagctccttggtgtcagtgttgatgcattggtgatacagatatagggagtagtgatagtcgtagagtggaagtaaaccaccttagggcctgttcgattctgcaggaacgcaccaagaattgttcctattgatcaaaacttaaacaaattagagaagtaatccggttcggaatagttccggtactccgttccataacaaccgaacgggcccttaggggtatcagatccgttttccctcaaaggaaactttcaatgtaaaaataaaaacattggaggagttatttggattgaccatgttcgttttcttctctcactggtcaatgatccaatcagattttcagaagcttacttatctttataaaacaatacaatatttataaaacaatacaaaataatggtttgaatgatacgagcaccacctcgccctcgccagattccaaagggagtgggccaggcaaagtcggctcttgcgtcgacatcgacggggagaaacagctgtgggcaggcgatgaactgtagcgcgtgacagtgaggggatttggttggatccaatgtttggtcggtctgcttgcatcacctggttgcagctctgcattttctggctataaagcgacggggcccttgcgctgggcgcggagactggagagggcgagagtcctcccatccacaagttcttagcttttgcgagattgagatccggctggggacagaccgacagaggaaggtgaattgtgggaaagtgcgtgctctcggctcttttcccgtcttccttgccttgtggttttgttttggaagagaggattcttgcttgggtaggattgggtaatttgagagttcatttctcgggattttgtggctgtacgaggcttttctgaggccaatttaagtagatgaaagttgttcatttgagtttgagttgttgagttatgtgctatctgcaatgttgtattgtttcatagagtagttgtttgttgatgtgaattgtgttggaaaaatgaattttgggcgtgctttagccgacctacttaactagtatctacaccaagacgatcctgtacccttaagatttgttattaggccctttgctttggctgtcctcttacttttgtttcaggaagtttttttgtgtgcatactgtttgactatgaatggaagacgtgttatcggattgttttgttcatataatggatctatatatttcattgctttaaggcactgttcatacataattacatgtatgagaaggtttgttctgagtaaacaatatatagaaatggaaatcaaaatagagagtgcataactcaaggcaacctagatctcatcatagtaatattctagtaagaaaacaattgtaactggctattcaaatcagtgatttattgcaccaagtttctgacttaaaaattttcacatccaggaggacagaaaa

SEQ ID NO: 13316 - DNA, 291 bp, Zea mays
gtttgacttttgtatattttgaatttggaactgatatatatattttttcagactaaaatttcaattttgtatagtactgaaaatgagaaaaaatcaccgaaattcggtgaatctcagccgagatttgcaaccctggtggcatgcagatgcttcatcaggaaccaatgttaaaaaactgtcttgcactattttgtaacgagacatagtattgtagaagttgatgacatggaaatcctgttagcacatcaatatattccttttttatagactcaaggaataagagccgggcca

SEQ ID NO: 13317 - DNA, 1500 bp, Zea mays
gcaacctcaggttatgtggggggtcgtcggcaaaacgacgctcgtttggcattggctacggcagaaactagtgtctggctgccattggttgtgggaggagcagaggaaaacaaattgttggttacactctgtactactgcgtcatgatattgtcggctttcgctttgtggcttttggaggaaaactggagatgtggcagctttggctttacgcatcttggaggaacaggagatataaacacacgcatttcgtttttttttttgttgagttgctgtgctccgtcttcgctgcagaatccagatcaaatgtggtggtggtggtgctgctgctgctggctacacgaatgtggatagcagcatttgtcgtccttgaatgcctgccgagaaaggttggtggtggtagagagagagagagaggagttcttctctcctctcgtctcgtctacctctgtgttctcttctctctcgcctcctcagatgggatggcattacatgtttccttcctggagaagaggctaccgaggccttttcttggtgacgtcgatgcgccaccagccccagtcactgccactgcccactgggaccaaccccgcggacggaggaccacttgtacaccaggtcgatcacgaccataccgtgggctggcctgcagatcttcaagtatacgtgccagtctttatcttggcataaacagatagtaccagtgcacgtagcctctagccagagtgcatgagtcaaagcgctatattctctgtagtgaagtgaagcacgcacgcacgttgcttttccttcactccatcggccaccaagttattaatgcattgcatgccagctggcccatctgattcctagcgacaggaacatcattaagcaactagtactagagtaatgtaggttgatgtcgatgatgtgtcccctcagaatttttgttgacactcgttgctggacctggacctgactagatggcggatggggggccattaccatcatccattcattgtgcgtgcagtactcctgctaccgcctccacggctctccatccatccatccatccatttgcatgcatgacccatcaagtatggaggaagcattacactacacatgtcttggccgaccatattctgctcgacggaaaaaagccagagattggagtctcaacactgactggaattacacatgaaaaaaaaaacaaatgagatgcctaccaccaatgccaaaaaaaaaaaaaaaaactaggaaacatatcatcatgatcatgtatctacaaagcagagcaggagaagaagaagcataaggttgtgcacatggacgacgttcgtttgtacctacagcaacgaattccaacactgtgcgaaaacaggcaagggggaggaccgggagacaagagagacacatgtactgctgcttattatcccatggatggaatgatggatgcatctgatccgatcaccggccgtctgccgaggtgaaggactcggcgaagccggcggggcgggcgggg

SEQ ID NO: 13318 - DNA, 1500 bp, Zea mays
agccccagtcactgccactgcccactgggaccaaccccgcggacggaggaccacttgtacaccaggtcgatcacgaccataccgtgggctggcctgcagatcttcaagtatacgtgccagtctttatcttggcataaacagatagtaccagtgcacgtagcctctagccagagtgcatgagtcaaagcgctatattctctgtagtgaagtgaagcacgcacgcacgttgcttttccttcactccatcggccaccaagttattaatgcattgcatgccagctggcccatctgattcctagcgacaggaacatcattaagcaactagtactagagtaatgtaggttgatgtcgatgatgtgtcccctcagaatttttgttgacactcgttgctggacctggacctgactagatggcggatggggggccattaccatcatccattcattgtgcgtgcagtactcctgctaccgcctccacggctctccatccatccatccatccatttgcatgcatgacccatcaagtatggaggaagcattacactacacatgtcttggccgaccatattctgctcgacggaaaaaagccagagattggagtctcaacactgactggaattacacatgaaaaaaaaaacaaatgagatgcctaccaccaatgccaaaaaaaaaaaaaaaaactaggaaacatatcatcatgatcatgtatctacaaagcagagcaggagaagaagaagcataaggttgtgcacatggacgacgttcgtttgtacctacagcaacgaattccaacactgtgcgaaaacaggcaagggggaggaccgggagacaagagagacacatgtactgctgcttattatcccatggatggaatgatggatgcatctgatccgatcaccggccgtctgccgaggtgaaggactcggcgaagccggcggggcgggcggggatgctgcccttgctgtcgtccaggctcatgacgctcccgccgccgtccgtcaggccgccggcctccgcgtcctgccagctcttcaccatctgcaggaacagcacgtcgtcgtcagttagacaccgcacatcacatgcatgggaaaaactggcacgcagctgttggaggaagtctagtttaagcaaatgaaagatgcgtatatctctgattaacatactgatcggatgctcatttggtgcaagccatatagtaactagttttcattaattggaagtgatctggcatgcatccgatccagtccatgtggagaaactttcaagcactgactaactaaagcatcatgggcgggaaagaaggaatatactatatacgtctaattacaatgcaaggtggctgaggtgaccaagctagccggtgtataaatagaggaacagagcagtagcatcaagagaccaggctggtggttgaggtgagaagctagaggagctagagcgagagagtcccatcgcaacacacaaaaggaagaggaagaggaagaggaaggcgagaacg

SEQ ID NO: 13319 - DNA, 783 bp, Zea mays
gcgaacaccatcgatgcctctttgcctttttccctcaagggaggcttcagggcaacaagccaggagtaatccttgaggtggcaacaaggcaggcttgcttggcaccgcactacaagtcatcaaaggggtgtctttacccaatttgaaaatgagagggatcaaattggtcgctgtccctacttaatgcttgcccacaacctgaaagctcggacatcttcaatccttttactttgagcttctgttttgtcatgcaatgaatccaaattcctatacaggttcttgtgtagcttcaggaaggcacgcctgtatttccacttgtcacagtaaatgttatgttttgacatgtaactaatgatctccatcaccctcgaaaaatatccacctttaagaaaattcaaaaccaagctatcaagcaagtccctatccaaatctagctctccatattcatgtctgcgctttatttctccccacaacatggtgatctccctatgcatgtccattgaagaataaccacacaacatatgacaaaaagtatgagatgtgggtctgatattttgctctctcatacacttatatgtgcaaagagcatcttccatcatttttgccttgcagaagaaaagaaccgaattattgagctctaatgccaagtgctctccagggttgtaatgtttaatttcatcagccaaagcagcaaccaaagatgaactactgaaggacatttcatatttcactacttcggcaatattattgatagtaaatggtgaatcagtatgaacatcatcc

SEQ ID NO: 13320 - DNA, 1212 bp, Zea mays
attcaaaagctttctggttaataatgggattctaaaaataagtcagcaaaacaaacggacctaaatatacatgcttactgattggtacgaacggactacaatacaacggggtaaattaaaaaaaacagtaataaataaacaaatgaaaatgattacgattaagccgtcgacagcgtgtagtggagacgctattaacccaaccagcgacaaaagccgtaaaggatgctacactgccaaccagctagccgcttgtttcattctttcttcctgctttcttctaccttcttcccccatcgtccgtagtagcttgattccctatgccgggtaggcggtagcatcgctctctgatctcacctacaccgctacacttaaacagcaggtaccaggaacaggcagggatcggagagctgctggccatggagcctggtcccgacgggcctgctggtggccaaggaaccagtgcgccagcggaggccgggccgtctccgtcgtcgtcatcggccgccgcagccgcctcgtcgtcgagtcggaagcaggcagagcagcaagcgccgccgcagcaacaagcaggagcacagcagaggcaacagcaggcagcaagggcccagcatcaggaagctccagcgccgcaggcggcccaggcccaaccgcagccactggcgcagcagcctccgccgcctcctcctccagcggggctgagccggtacgagtcgcagaagcgccgcgactggaacacgttcctgcagtacctgcggaaccacaagccgccactgacgctggcccgctgcagcggcgcgcacgtcatcgagttcctccgctacctggaccagttcggcaagaccaaggtgcacaccgagggctgcgcccacttcggccagcccaacccgccggcgccctgcgcgtgcccgctgcgccaggcgtggggcagcctcgacgcgctcatcggccgcctccgcgccgcgtacgaggagtccggcggccgccccgagtccaacccgttcgcggccaaggccgtgcgcatctacctccgcgacgtgcgggaggcgcaggccaaggcgcgcggcatcccctacgagaagaggaagcgcaagcgcggaagcgcggccgcggcgcctccagttgcgccgcctcctgttgtaactgcagagaccgcagggaccacgtcagggaccgtctgtgacgaggaggaggaaccatcgccgtctgcaggtg

SEQ ID NO: 13321 - DNA, 155 bp, Zea mays
ataagtgcagatcatctacatatcatcacctcccaattctaatcccacctccatcttaaatttttagttgcctattattactatatatttttattgcttattgatataagagaggtctaagggactaggatcatgttaggagtacatccatataa

SEQ ID NO: 13322 - DNA, 1500 bp, Zea mays
aacgagcaagcatctctagcaataagaaaaatgtgatttgagagacagacttcgagaaagccggtgtcaatgcaagtaaatgcaacatgcccaatgatatatctgtagaccactttgccatgaggcgcaaagttgagaacaaatagattggtcttggtagaagatatggtgtaatgttctatggatgacaaattacataataggtggcaaaacctagactcaccaagtctctaacaaaggacctaatgtcaatagtataggaaataacaaccatggtgttgggcggagactgaacatgcccccgatcatggagcgaagggaccttcaactcgtcatatcacggttactaacctacatgcaggaccactgatgatggggtcttcaactcttcgcttgaccacaatgaaggatgaagttaagcagaggccttgggatggtcaacaccgaccaaggccttcgccacaacgccgtcatcgtggggcatgtgccatacgtttgttaggagcagtgttttaaatagcgagctatggcatttagtgattggcctcctcaaacagctaatagcgggctcaacacgaaggacaagcatccccggctcctagtgtattaaatagcgggctatgacatttagtgattggcctcttcaaacagctaatagcgaactaaatggggctataacgggataatagatcaattgtgcacgaaagcaaatagctattttccctcaaaacagctatagtgcaaggcgcgctcccaagagcccagtctggcgggcacacattgtcagggaggcctacatatagatggtcatttggcactaacacgatgggccagcccaggcacggcacgaaaaagcacggtccaggcacgacccggtccggttagtatagtgccagtgcctggcacggcacggctatagtgccgtgcctgggccactatctcgacccgtagtgctggcacgggcacgacacggttacattttttattttaaaaataatagtttacatatattaactataagaattcaacatataatagaataaaactgcagttgcactggttagatgaatgcgtttaagcctcttatgcactaggttgtgagttcaagcccccacaactacacattttttgctaaattctacaatatactcagatgggccatagtgccaccgggccggcccggcacgactaacagactcacgggccgtgcctgggccgcggcagcggcacgccggcccatctaggcacggcacggtttgctacccgggcctggcgggccgtgccgccgtcgggccgtgccggcgacgggccgtgccggcccgtttggccatctatacgaccagcattgcagctcgtgaacagctagctagcctttgcaatattgaggggttcggctggctataaataatacgccacggcggcccaggcatatcacagcttgcagaatacacctccttccttccttcgttccacaactcaaagtctcaaagcaaccgatat

SEQ ID NO: 13323 - DNA, 854 bp, Zea mays
cgttgcatgcctcatgcgtgcaagatgaatcagctctaagaagacatgcatgatgaataatctgcctctcatttttattacaaatatttacacataaatattattttgataacattattagaaattaggttgtcttcggtgtatcgtaaaaaataggagatttacattgtagataacacaatatttacagaaagtgaagtttaaaatagaagataaaataagaggatgagataggagtcgcggtggatagcttacagtttacgaaaagttatattgtgaaccaaatttatattcagaatcaaatagagaaaaattatattttaagagctaaggtgtcaaataaaaaaccgtttctatttttttaattttgtcagtaatagagcctgcgcaaagggtctttattcgaaataaccttgtttggaagggttaataacgaaggtggcactgaactctccagtcttcacagttgcagacttcagagctcccaagattattcctttcttctcagcgacaccgctcgataccttgcgatcccaagatggcatcgccgccgatacccacacagtaatcctctcctcgctcccctgtcccctctctccccgccgccgacgccgagcctactctgtccatttccggactcgccgtccctcgcgggccggttcggtccgagcctgcgccccagccgcgccgggatccgcgagagaaccgcttgccctccgtgctttgcgggcggtccggtgactggctttgggattcctatgccggggggctcgtgagcgcaatggggctgtttgggtgaactagggcttgcttctgtgaattctgtgagggtgagcggagctgtgggagggagg

SEQ ID NO: 13324 - DNA, 457 bp, Zea mays
ggaaagagatcgtaaaagcatacaggggtatttttgtctctttgatgctaaatacatggaaataaattaaaaaagagagaatacattggttaatgacagtataatcaattaaaatatgtttgtagtaccattgtacgaaacaaatattttagatggcattattataaagcataatatttagaatctcaaatatgcaattttctcgccggagataatctaatagtaagatcgacaagcaaactgccttctcctttagcgctcaatcctcgtcagcccagccctttgccctctccaatctccacgaaaagggactgacgagtgacggactcgaagcccgaggagacgaggccacggccgcggaacagaggggagagacgaaccgcctcctcacttcctcagtactcatttctttcacgagaagcaaaagatcatttaaaccccaccactctgatcacct

SEQ ID NO: 13325 - DNA, 149 bp, Zea mays
caaccactctcttcttcattgctccacactaccatctcatctctccgccattttacaccactcccttctcgttgcaacccaacaaattggcactgctcgtcgccgacccctcctccctccccgcgtcccccgacaagccatccgcggcc

SEQ ID NO: 13326 - DNA, 1500 bp, Zea mays
caagatctacttcacccaagatctctctgcaccatggcggacaattcggcgacctatcgcagacggtcaggtgacctatcacaaatcgtctgacaccttatagagttgaacctaaggtcttgctcatcacgagaatgccctagggtttgttgctatttagcccaagaaggcgtcaacatagaagtgatctaaaattgaccgatggttatttgtcttacatcttatgtaccatctcgcagagaggttctccaaggcctcatttccgttagtgaggcctagagatagttagtgtttgacaaaaagggcgccaacataagtagtctataaaaatatattcgaagatagaaatctaattatgtatgtttagtaatactaaatattatgtgtgtttttgtaaaaaaaatgatcaaacataagaaagtttgactgaatactagttttgaaattacatctttgattcctttgtaggatgtggtagtacctgattttgatttttgcctctcagaccagccagacaacctgcgcaatttttgacgaattccacgtcaaaactccaacacagcgacggttaaggtgcgcggcgacgacgcaccgatcagcccgtcgcttgcatgtaccactcactgcaactgcaagcgcaacatttccatacttgacatactcggcgtattgattgcccccatatggcagtctctgtcccttgacttttggcaagtgcaaaatagacgagacagtctcgaggtcgaggctagctgcttctagcctgctctcttggttggaaattggagcttgtaagcacgaggtactcgagtagtaatgagctaaaccgcattgaccgggtgtctatccgcgttaataaaccatttgccatatcattaggccatgtttggtttctttagtctagggactaaactctagttaagggactaaagtttagtccctagcatgtttggttctagatgctaaaaatagtaagaatatactaaatgacttataagaagactaaaatggactttaacattcttctgctattagtacaattgaactaaatgaagggtaaatatgaaattaatattgtttagtcccttttagcacatatgtaaaggactaaagactaaatcattttagtccatatttcagtcctagtgtttggcaaaaaagggactaaatgagactaaaaactagagactaatctttagtccctctaaccaaacaccccctagcctcctttgtctaactacgcgggcgcgggcgccaaagagaggtgaacgggcaatctcactcactctccttcgtagttgaaattgaactcgctggccgcctgtgtatagtccagtacttccagctagaatctgaaagaaactcgtcaccagctcgatctcgtccttcctcccttcgctcgactcctctgcttctcccccatccggtacgtgcggtgcggggaggctagccgggcggccggagctccaaccgcaatcggtctcttgctctgctgctgcg

SEQ ID NO: 13327 - DNA, 774 bp, Zea mays
atgctgcttcgaatctttcgataactttgctccatgtactcttagaagttttactttcccagtaccccagtgtagtcataagctgcttttgacatcattccctttggtctgcctcaagttaagcagtcatttgcacaagtaaacgaaggttcgttggtgaaccactcctcgacatgcctcaccctgtcacccaaactattgtggttagtctcaggatacccagagacaccacattgtaacttatgtcgatgatccttcagaactgttgtgcgatgaagctaacaatttgctctaaaagtactttgcttgctctaaaagtaccggctatgtatatttaaatcagcacctgtatgagtttttttagccctcacaagccctggttgcagtcgactaggccgtgtgattgtattagtatgctatctttttaaactgtcgcttatgagtctttattctagtgcattgtgtgaatactctgttcatcgcatgcaagtcttgtcttctgtttctgttggcttggtaggagatactctgattttataacatgtcagatttttattggtcaattcaactttgaccatcaatatacaaggaatttggtgaatacttgagggccttgttgaggactattttgttgaagaaccattatatcctgagggctagtttaaaaacttaaatcttctcctgaacataggatattaaggcggaaattatttcattttccccttaacccctcgaatcctgaggaatttaagtttccaaactaatcttgattgt

SEQ ID NO: 13328 - DNA, 495 bp, Zea mays
ggtatttttttatttgcttaagatatgttttctcttatcaaatttgcaaatcattggaatgccttagtattattaaaagtgatgggtatgttaaaaggaataattttagtagttttttttttgtagaaagaactaatttaggttgtttcagctgtatattattgtgctgcaaacatattgtaagtgctgtagggttgctgcttgtctgcatgtatatatgtacgaatctcatcctgtctttacatcttaagtcttttcccatcgacaaaaaactttaaaacaaactctgcagttgctcttttccagaacaaggtacaccaattctgttggtatttggatttggaggattacctgtgatctgatgacttgctgtcatattagtagtttgtattccgtatcaaataatggaaaccatatttactgaaactcacatgcgtccttctattctagatttcaaactggttcatcaatgcccgtgtccggctgtggaagcca

SEQ ID NO: 13329 - DNA, 210 bp, Zea mays
ggtaaagtttcgttgcaaaaggttgatctgttgtactgcaatgctcaaagttcttttttttatgggtgtaacctaaaggttctgttactgttgggacttcaaagggattttgttgttgttgttgtgtgatctagaggtttcgtaaaaagatgttcttttttctggggttgttcctcaatctcctatctccattacatctttcacattcca

SEQ ID NO: 13330 - DNA, 95 bp, Zea mays
ctactagctccttcttttcttcgatctccgcaatctacagctttgcttctcccggctcgagcggctagggtttcgggagtgcgcggtgagacggc

SEQ ID NO: 13331 - DNA, 1500 bp, Zea mays
ttgataatctctgcgatggacatagaaatatgcttgggttgaattaacagtctcccatcgcactccataataaatctattgaaaatcaaaatctattcatgtctgattgtgtgataaaatcacccttttcatgtgcggtctcttttctcttgactttggtggtgattgcacacatacaagttccctttgcatcctttactgtaaaggtgaagccttggggctatttactgttggaagacagctgattagttctcaaaatggagattgactttcactactgctaagatgcaggagtttgttcattcgctctcttatttaatccatgtgtgcaccattctcaatagactcagatagtacagtgttctcagaaaaagcaaactgcacacatggaaccttatgtgctcttctggcagacattgtctctattgatagacatctcaaattagcttaaggtgatacattctatggtcaaatagagaaacaaacatactgagatactcgcctttgcttggaactggcttatgttattgttgatatagacaggagttacatgcttctctactcttaaaagtctttcactccgaatctcgggacgagattcttttaaggggggagggctgtaacaccccatgtgtttatttcccgttcaacatcgactatggacttaagcacgagatatcagtgaaaataaaatggacactaaattctactcatctttgttatcgctattttgatatcgtatctatctctgtctaagccgtccaaaaattttagagatgtttgaattttagaaatctttcaagatgttgaacctatgctatttggattgatctagtacgcgaatatgagaattcgattttataaatttgatcacaatccgtatccaagaaaaatcaggcatagagttataaattgagctgttttctagatagatgttcggatagcggtgaaatcgtctaggctcaactaaattaaatagaactcaatgactcaaatttttaggtgtaaaataatttagtcccctctcgttaatcgaaacgtcacgtccgaggatttataaatgagatatgtttctccactaaattgtctagagctgtggaatcaggtgttcagcccacatatgaaattatttgatttcatatcgaatcgaacgcagcttaaaatagtgttgttgacatcgttccagttcgttccgattgtttctcgcccaaaacccgggcctaagttagatatatgtctatactaatttgataaaaatatggagagggaaaagctaacttttatcttttatgtcacgtgttttctctggaagtatctcaccgctgttctctactctcttatctcattcgtatgttctcctgctgtttccttctatagcgcaatgccccctcctctctcagccagtcagccttatccccaaatcgcttcttctctgctgattccgtggtgcatcagccgagctcctctccctggccgatccatggtgctcgtctctagctc

SEQ ID NO: 13332 - DNA, 615 bp, Zea mays
tatgccatatacacctcacatatataatgttcatcaattattctgtaaatgatatgtatatagtttcgttttactggaatatggtagctcgtttagctcgcgagctggctcgttaacgaaccgagataggatatcagctcagctcgtgaaaaaattcaaacgagccaatccaagctgaaccgaccataaaccaaacgagccagccacgagcatttcgtccagcactacgtgaggcgggtccagtaaattggcacaaggtgaagctatgtagcacagctgtccaccttccgcgtagactcggatcccacctagtcaatggagtgagcaacgagggttgggttcggcagcagcgagggaaaagccaaagccccccagggcagcaggaagcaatagaagcgagcgaggcagcggcgtggggcgaggagtggaggacaccgatccccgccggagagcgcgtccatcccaaatggcgactgcagcttcgcccgccgctgcctttccccacatcctctccctctcctcctaatcccctcccaatccccccctctctctctcttcctcgccagctggttcgttccgcacccgccgccgcattgggtgccgaggagggacgca

SEQ ID NO: 13333 - DNA, 1375 bp, Zea mays
gatgtctgcagcacccatgagtagtcagtccatggccctcgtgcacatcgtgatgcatcagaatcagatcctcgcctcggtcgcaaggaaaaggaagcatcgcatgtgtcggcaatgtaccggtaccggcctttcccaatcatgttttctcagacaaaagcatgcgtcgctactcgctagcattattggactgtcaggtactgctcgctcgctttccacggcacaggcacagctggagcgtgcgtgcctgaatggctgaaccggccactcattccgtccgcgtgtctgttgctctggagcagtttcagttccaagccatggagcaggagcaggagcatggatggtcgtcgagcgtggaccgtggaatcacttagcttccgacggatggcagtgaagacatgcgcactcctttccagaagctccacaggcaggcagcagagcgtctgggcttgctttgtcaagggccaccgatcgagggctgtcactgtcggggaaggaagcaaggaatgatggaagggagcaacaagcagttcatcgatccaatataatggagacgcgccaccaaaccctaatcattggctcggccgcgtctgatgctaaaactctcaaggagattaccagtgtactgttcctgtttgttatacgagaccccattcagaattttgaaagaaagaaagaaagaaagaaagaaagaaagaaagaagatttgctcggactggcttcgcaagaacgtcaaggaggatctttgcttcgggttctgagactgtacagggagggacattcagacactgatccacagtgggcgaaactgaatgccagtcaaaatgtttggtaggtaaaataaaacacgagactggcggggaactgaatgcggagtcaggaaactgaatcctccaggcagcatcttgcgctttttttggatccttgcatctccttctctttccatcctgcacagcgccgctgctgcagcactgcatacatacatacatacatacatacatacatacatacatacatacatacatacatacatacatacatacatacatacatacatacatacatacatacatacagagcagagccgctgggggtgactcaaatttgtcttcatcacatagtgcaaaaaagcaccagaaaagccgtacggacgctgaacaacacgcattcctacaatcggacaatcctactccaagcattgagggacacggaggcggcgccgttcggcactgcacgctcacgggctcgcgcattagtggatactctcccccggcgccacgaaatcgtccgctctcaccaccttccatcggtccctcacgatcttgccaagaatccaagatccgcctgcggtagctagcggtcctatcttgatccg

SEQ ID NO: 13334 - DNA, 328 bp, Zea mays
ggtaagcaagcaaacttagttggatagtatgtacaatgcaaaataaaaatggattgaatgttatatgaagaatgccttcacaaagggtctgtttggttggtttctctcgccaacctggctgtgtgagccaggatcactggagcctggctctggagatgcgaccaatctgctcgtatctggtgagcctggcccaaggtgctttaaggatcgtgcgagtctggatccaaatctacatgcaggcaaccaaacacagagctcgcacgcgcatagcctggctcacagcaaccaaacagcagctacccgcatcctgtgatgcaagcacgcgcag

SEQ ID NO: 13335 - DNA, 1476 bp, Zea mays
ggtgtgtttgattttttgagagtagtagcgtggaatggtggtcatttgctttgatttttttcttcttcctcggattgctgtgggtgtagtttagttgggggattttatctctccctatagcctatcgggtttatgttcgtgctctcggagtagtctgtgggcgggtccttatatttagtgttcgtgtgtgaggtgatggtgtgctgtcgattatgagcggctggcgttttaatgatgtaatctgttgggattggcctattgggagatctggacaggttccaaatctcccgctatagctatcgttatagttggttgagacaagagagaggtttataggggaatgtttcagtcattcaacggagacacagctcatgttgggagctagattgccatgcttgggcgttccaatcgtgtgattttgtggcgtgtggccgtgtctgtttctgtcagtaaaatgttccagatatttaggatcttaacccgtaattctagctactatatataatggataaaagttatgtatgtatatttttaggattagaggagatcgtcataggatgacaaagcctgatagtcgatatcaatgtcaaaggtgttgctagcgatgttggtggctttcctctcactttcgtatagagataggtcaggagacgaacattggttcgtgtgtagacccttgtttctatttatgttacatgatgtgaaggagaaccacaaccgtggtggttgttatgccctcgctcagggcgtcaagtccggatgagattaatccaacattctcctccttgatctcatgcttacttagaacttaattttttaattgcttaatctcttaggttataacttctacttctcaatagatcagtatgccaagactaaaacattacaacaaccaaccatgccttgttgaatttaataactataatacatctttctatctcaaaacagaaaacttatttttgagggagattgttgcattgataaccccttaatccagatccattaaactcatgccaactataggtactccattaaactcatgccaactataggtactccattaaactcatgccaactacgtgttttctgaacatattggatggaagccttttagtaagcggattcataagcagttgctctttctttatatgctcaagttcaactgtttgattctttacttaatgtcagtgtgtttgacaacaatacctgacttgttatagaagtaaaatactgtcgattcattatcgaagtataattttagcgattttgtgatattgtttaccacttttaaaccggatacaaacttctttagccacatagccttaattgtgtaaattttctgtggtagggtggcataatcctcaatatcttctcatacttgagatgtgttcattacgtttgtcatattgtatattaacaatttactgcatgtcttttatgattgcacaggtaccctgctggaggttgttttgtatc

SEQ ID NO: 13336 - DNA, 768 bp, Zea mays
tgctgagcacgaaatacaagcaaaaacctaatgcctagaccccctacctggcgcgccaaatgtcggagaggaaatctccggtcgggtggcggagtgcgtaaaaatttgccagataaaaagggatgaaatattgattaccggtggccagttagtagagcgatgtcatgtcctttctactctctgcctcagcaggtttagcaccaaggtgcccaggcggccaagcatggtaggggccaggggccgagcagattgtgcgggctcctgccgctgccggctgggagcctgccagcctgggagacttgctgcctagccgcctagagagggggttggagggttgaccggctgccggctgggaccgagacgacgaacaggcaagctgcaagctccaagcggctgcggaccacagtggagaggggcgaggggggcgctggcagcttgcgagatgcgtcggcggagccagcaagcgtgggtgacggcggacggagaatggtggatcgagaggcgaggtgcgaggtgctttgggctgggccttcaaggcctggttgtttatgggctggttttgtatgggctgcagaggcgaaaaacacatccgcccctggtctgcccgtcgcgctcgcgcctccgttctctccccgttcgccgctcggttgcttccgccgccgcttcccctggctgcctcgtgtactggtcgagctcaagcgccccatttcgggctgggtccgggaacctcgaatctatctcctaaccctatcaagctagctagctgcg

SEQ ID NO: 13337 - DNA, 1500 bp, Zea mays
atatatttactcggttatcagttttttagtggtttttctttgattgcgaataaatagaatatataatatactgtatgaatgtgtattcttgttcttaatattgagcttttaaagattcataaaaggtaaaccgcaaattcattctatactttctcacatgatagaaataaaatttggtatggattcgaaaacaaattcgataattttatcaacttttagggagcaaataataaataaaataatttatgtaatatttaattcttatttgtaacaatgtgcttgataacataagaaaagatcaatatcaaattttatacataactattttaaaatattaaatttatactaacaatttgggttaccactataggaatgcatccttggtcaaggcaaaattagttgtagattaccctagatttagtttcttgaccaacctcgagggcatatccaatattctttcttttatttttttggtttctcttattctgactttctatattctaccctttaacaaattgacacatcaagaccaatgatgtcacaaaactcattgactataagatacccctctgtctcaagttaggataattttgtcaatctgtgatacatttgtcgtagagcctcttaagctagaatcatatgttttcctttaatcttagactgcttacatgttgtttaaacacaatgggtggaatattttttttagtagatccactaacatctaatggatcgatatgatctactttaatagtttgatcctggatcttctccttagcaacaaaacacttaatatcaatgtgcttagcaatcccacttaacttgttgtaggtgtagattctgttggctattgtcacttaacgctcgttggtctttcatgttgtcagccactcttaatctaagtataattttctttacccatattgcctgtacagttgtctcatatgttgccacaaactcagtgtatggtgtcagcgatgcaatgactgtatgcatttctagaggagccaatacataaaaaccattttgcgaaacaacttctatgttatttttaaaggaaaccatagtgatatagccaatcttaattgtaagttgttacacgctaatgggtcgagaatcgacggtgggaaagtctcttgttagttttttcgcagtatgtccaaacgggctcgcaaaaaaattcctcctttcatggccttttcccaaaacctttctccccgagaacatggccacagagcaaatttctgtgttttttttcccatgcggccacgcctttgtgcgtcagaatttaccgtttcccacgcctcctccaacggtcgattttcttcgacacagacaccacaccgccacacccacacgaggtgctcccattaaaccctccccaacctcgcgcctgccgccctcaagtccacctctctctctcctctccgcgtacgcccccgcacacctcaccccacacacttcactgaagaggttgggtggggctgtgggagggcgagggag

SEQ ID NO: 13338 - DNA, 1500 bp, Zea mays
gtgagaatcaggctcctaatttgcagaagtcataacttgcaaaatgcattatgagctattttctgcccagctgcatgttgctgtcccaatcgaggtttcagaatatgcatggcttgtgactcaggaacgattttttcacctaatacttgagctctcgtacatcaaacatcaatgctgtcccttcatcattgaactgtgtgtatgcatgggtgcagcatcatgttgaggattagcatcaaggtattttcctccttgcccagcctcactcaaatttgttcccctcggttctgcaagtcattcatgcaaaacgtgtagtcacagtttatggcaaaacaaagaacccaataacgagattcgcattcttaacacctcagatcaagtccagctttgtttttcagaccatacgcggtatcttgcccgtgagattgttgatgttcgggtatctgccattatcagaaaatgcattaggcaaagaatgtatggagatattatttgagatgcattatgaaaatgggatatcgartaccaacaggcaacagctccttaaattgactagtttttccactgaactgattgttgttgagatacattggttgagtggctcccgtgggccggcctcccgtgcgcctggctcgccagcgaagaccgttcgctctatctccacgcgtgcagacatgtggtggaatataggtgtggcctgtacctacacatgcaggttggtatcctcacatacaagtaaccaatcataatctcgtatccagttaaagcgtgtggggagcctggttgcttctgtaaaagcaaccaatcatatagtatgtatgcagggatattatttgagatacattatgaaaatgggatgtcgcgatacattatgtacgcagagagcattatgttcattttattcatttggtatccaatgtaaagctgttttgccaaataagatcatgaatactgatcagcttcaccgaaaaagttgttcgtgaagctaaaacgtcaaaaccagttyctgttgatggtcggcgccgcgctgccgaaggcccgcccgcggcggtggggagcgagcaccaccggcggcgacaagaggattggaacctgttgcttaacactgccagcagagccaagcccgattgcccgaacacgtgcttaggcaggtctggtactggcaatgccgtgcgcccgtgccatcgggattctacagaaaaaaaatgagcaaagcgaaaatcctctcccgtgaaaaggagacgagggaaaaaaaatagaaggaaacaaaagcagagagcattacggtcattttatttgtttattgtccaatgcaaagctgatttgccaaataagatcacgaaaacccctcagcttcatcggaaaagctgttcgtacgtgaagctaaaaacctcggaacaacagctccacttatgaaactgagctggcctaaatgtacccacgaaccaaaatgctgcgcgcctagcgatctggctctcgaccagctacgtgtggggtatt

SEQ ID NO: 13339 - DNA, 1299 bp, Zea mays
agtgcatagggtggcttctgtccttgcgttgaatgtgtcgtttgtgagctgttactgtaaaatggagtactgtatccagttctctgctgttgttgaatttttactctctcaaaccgcgtagtgcatagagtcctccctcgactgcggacaaccaaagtttgggttggcacgagggaagggatacgaatagagatgacaatggatacacgtgacacaatatttgatgggtatattcattccattagagtatgtatatgggctaaaaactctaccgcgagtttcttattggtcaaaatcttcaccaaataggtaaacggcaccgcaacctatacccgttaacatatgagtataaatatacccaatataaacttggcgaaaacatgagcttgggatacaatcatctatcttttttgactatttaacaaccctttgagcaataatgtcatagaagacttaacaactactcgaygtctatataatagaacatatattgtgttttttgatactattctagtgttgctatttaatctaattatctgtggtggtgttgaatggatgattgaataatgctaaattttttgtaatgatattagatgaatatatttcatattcgtatcatatattattttgtaatgatacaagatattccatttagagtagaaatttagagttgtatgagtgcggatagcctaataatatcctgtgagtaatagggaagctgctgcagtgtcgccgtcgtagcgacggtggcgtcctccctcccacgagagcaccgacgtccggactccggttcggtggacgcgcacggacgaacccctctggaaagagagaggattcctccgccgcttccgcgttggacgcactggacagctcacgcacgccgctgctttcgcagccagccagttggttccaacggaacatttccatccacgcccgccaccgcgcaccggcatctccatctccatctctatctctgatccgctgcagcccgcaggcacgttctccatcagtccggccgaccggcgcgcggcaggcagcgagcgggccactgtgtgcgcgcgcagcgcagctaccgaattttcgctgcacaaaaccagaggraggagaggggagggtgggggcaaaaagggaacgaaaagaaagggagggacagaggtgcagggccaacctgcgtggtgcgggtggtttcgagcacgggcaagcgccaccccgctcgctgccgatcccaatccggctacagcagcggccgccggccgccccgcctgcggggcctccctccgaccgttccccccgccctcc

SEQ ID NO: 13340 - DNA, 627 bp, Zea mays
ggtaaagtttcgttgcaaaaggttgatctgttgtactgcaatgctcaaagttcttttttttatgggtgtaacctaaaggttctgttactgttgggacttcaaagggattttgttgttgttgttgtgtgatctagaggtttcgtaaaaagatgttcttttttctggggttgttcctcaatctcctatctccattacatctttcacattccaatgaaatggaatatgacttttcagcatccatgtttaggacggaaagggcttcaacaagtgtgctaccaactgtccaactaccaagataagcatgcattgctgttttttctgtagtgatagatgcttttatgccaccatttggttcattttcacatgttttctttagcagaatcagtatggaaatactgctctttttttgctgtctttgttccattttctgtactatcttctccttttcatgatctttgttttggaaattgcgacatcaaatcccagtcaatctaaactttgtatgcttgcttggtttatctagtcatgtattaatactcatcacatttcagtgtctgctttgcaaaccaaattgatggttaagtgcttgcctatttgttctgcctgatttcatcgcagctcagttgt

SEQ ID NO: 13341 - DNA, 632 bp, Zea mays
agctgctgcagcaacagtgtgtggtggttgcgttgccgcggtggttttgtgcgcccgacatgcctgatcgatttcaccccggccggccagccgggcccggcggtgctttttcgcagagatttttaaggtcgtgcgtcacggctgccgatggcggccgctcgcctttctctgctcctcttccgcgctcgctgccgcgcgcgcgcggccgggcctcgcgacctctccctcctccgtctccctctcttgcccggtcaggggtccacatagctttggttgcgcgcgctctctctctctcatggttggtggcacttccctaccctagcgaaactaatcccactaggcggtgtcaggggagctatatataaccacctccattgtagcttgtttccttgtacccggcttccctcgtcaccggctccggctccggcaccggctcaatacaatcccatcaccgatcattcattccctttgcctacgactgctacctccccctccttccatcttcgatagacgaccaaataatggcggtattcgacgtctgaatcctcgtactgatcttatactgcatacagacagacagacccttcttcttccttagttccctatagctagctctagctaggagaccgatc

SEQ ID NO: 13342 - DNA, 85 bp, Zea mays
  unsure (1)..(85): unsure at all n locations
ctgcagaggtctgtggaactgctcggctgaaacccgcctgcgnnnntnancnatgaatnttgcgctcgggtgcagtctgatctac

SEQ ID NO: 13343 - DNA, 936 bp, Zea mays
tttcgtgcttgggttgtagcctcagccgtagtgctggctcggcccgacatgattatatattttttattttacaaaaaaatgtatatacatatatacaatttatgtttaatattaaaaacatttgaacatgatgttatactggttagatagcttcatacagtgtctcccgctcttctttcatcagagcatgggtcaaaccccacctcgtacactatttttttttaatattttattttacaaaaaacgtatatgtgaacatttgagcatgatgttctactggttatacagcttcacccagtgtctcacgcccttctttcatcacaaggcatgagtttaaatcccacctcatgcactatttttttaatattttacgccgatttaatcaaataggtcgacgggctggcccgacacagtcaggccggcatgacatgcatgagccagagttgtggcccgcgggcgtctggcccacgtcgggccgccgtttagccatatataacatgcaacagattaatttgaaatagttgtgaggagttatttgtaaaaagatgacgcgggacgaccttgaaactgatgttttaagtatagtatatataatagtatagatatagaggacgtgtttctccctccgtcatctataaatatttttatacttttaagaattaagtaaaaaatatgtaaaaacgttttaggatatatagtatgtaaattacaaaaaatcaatatataaaatagagaccgtggaagagaaataagagaattctttagagaaatacagtctataatatagaagaggaatataaataatacagttagttgtttcacacggacgcgcgtttgtcgtgatcgacgatcgagaaaatcctagggttttcctctctcgccgccgccgacttaaagtggacagaggagtaggcgaactagcgccgggagagtaac

SEQ ID NO: 13344 - DNA, 1333 bp, Zea mays
tattttcgtgattactaatgttgctatagtcaacactagtcatcaattggttttttactataatatttttgggttaataaatacatatgctttaatttgctattttttggtaaagtttaaactgatatattaagatataccaagaattataagagattaaatttcatcctaaatcaaatcatcataaatttgaccaagtttatagataataataacaataataaaaatatcaaattagcattgttattcaatacattatgaaatacattgtcataagtgatctatttgatatgttagatattaaccatcttctctataaatttatttaaattaggctatgttctaaatctctaaaactaatagttagcggctaatattagttgagtggtttagaatgggtcaactaatggaccgactgtttgttagctatatcccaaatagccattagttgttaactgttctaatctagacaaatcagctaataggtagttgatgatcgaattatctctggcactttctacctaaccgtcgatttttcccttacaaagaagtcagtctttctctgagcttctcctgccctggctcttgacctagctaggtgcactgcccgtcggtttgtgttgaacaatttatttattttgtatgaaatttaagtttgtggaacccacttgtgtggtatttttaaaaaaaaattatatactatttataatattttatttttttatttgaaattttttatttcccaaatattcatagcaatagtagcatactggatagaaatatgattcaaaaacaaagagaaagagacaatggcagcaattacatttagctcataacaatctattagctttaggtttgaaacacccctaactatttagttagccggctaactaacaacttattagctggttaacaatttactctatagagacctaagtttcactcggaacaaacttcgattccttgtgtttgagtacggaggaagtattttgtgaactaattatccattcctaagcgctgatcatttacccacacattatcaagcatcccaaagtctaatcttatgcacatggcacatgcataaaagaaaataataaaatatttgtcacgctttttattattgctctccggtttattacaggcgtcagccggaaaagcttccgctcccaactgccctcggaccctccttccccccactaccagaactcctcacctcacttcactcttaacgcctaccaaacttacacagcctctccataactgctgctgctcctccgtctgcttccgagctaccattctctagcgcgctaccacggtaccaccacgcccgccc

SEQ ID NO: 13345 - DNA, 1090 bp, Zea mays
gttagaatgtaaatattaaatataatttaattataaactagtcatatagatagatgaatagtaaatgacgagacaaatttattaagcataattaatctatgattaataaatatttactctagcattacctaagtaaattatgaactaattagatttaatagacttatatgtataattagtcttgtttaatgttcatgggtgtttggttcttgtgactaaagtttcatccacgttatatctaatgttagaatgtgaatattaaataatctaattataaaactagtcatatagatagatgaatagtaaacgacgagacaaatttattaaacataataaatttatgattaataaatatttactctagtattaccaaagtaaattatgaattaattagacttaatagacctatctgtataattagtcttataattaaactatatataatagttttaacaagtatttaaatattcgaggcgaccgaactggtgtatgagatattgagatccaaactagtccgaaatacgggcaacctgctctctctcgagaaaaaaaaatccgccagatttgggcccacctgtcaacaggcagcgaagcgcctggagactggagtggagagcggagagaaggacatgcacggagacggaggcgtcggtggcggtgtcgccatcatcctgcacgccaccagcgacgaacacgcacgcgacgcgacgcagccttgtcacgccaggacaaatccagcgctccccaaagcagaaagaccgcgacccaaagcaagctcaagccgctccgctcctccagtctccagtctccaccgcccgccaaccccgagatatacctcccttcctctcgaagcttcgtctgcagacgaagtcgccggctcttccctcggcgctggtgccggtgggttgcctgtggcggtgggtgggtggccgggtggtggtgttgctgggatgcccgccgcgacggcgaccgcagcccgcctccgcgtgccgctgccaaaagccgcccaccactcgccctgctcgagccggcgccaccccgactgccgccgccgctgacgagacgagcggccacacgcttggcgcgcgcc

SEQ ID NO: 13346 - DNA, 88 bp, Zea mays
gtactcgcccactcccggtgaaccccaaaacccttcctccccaaacaccggcggcggcgcgaccgcgcgagggcttcgctttgcatcc

SEQ ID NO: 13347 - DNA, 492 bp, Zea mays
atccccttccatttgaaacctagtgcctgctttacatttaatcacttctcatatgaaaccaatggatataatttgatgctttggatagtttgattgcagatttacaacaaataaatgattggataggatatatcgtcgattaaatgagactaaaatatatggactaatttttagtcactcaaactaaaccggcatagtgtgcggttgcgtgatctgtgcagcgtagatggccgaatctagcatgagcagcgaggaaggatcaaaccgcacggcccggcccgtacggatttctgggccaggaaagcaccatgtgctgggccaggaaggaacacggacgccagtgttctttcgtagaggagtgaagaggcctatctataactcgacgcgctagggttttccatcaccgccgccgccgacgcatccaaacccaaatcaagccaccaccctctcctcctcctcagcggcgagcaccaccagcaacagcgagacacg

SEQ ID NO: 13348 - DNA, 111 bp, Zea mays
cgcctcgcgctcgccaggccttatagtacccctatcctagggtttactcgctcccatccactcccaagtcccaacacccgtcggcgtcgagcagcggcagcggcggcggcg

SEQ ID NO: 13349 - DNA, 833 bp, Zea mays
ggtccttttgcatcttgtttcaactatctgcgctaagaaatattctatctttttttgggtggatctatgagaccctggttttgagcacttggtaacgaatatgagttcgattatatcgatgctgcacacctcttgctgcatgtattattcattctatgcagttgcagttcatgtgggctgtgctactgagatatgaaatgttttggcatttttctgatacgtctaattgtggccttgtggtcaggcattgccctccttttttctggtgtattgttgcaaaacaacaaaatcaattgatttcagtcttgcccactaattttctggcgtatggctgcaaaacaacaaaatcaattgaaagttgtcgtctattttatctttttatgctatgctcctaagaaaatcaattgctggacaaccatgtgttgacaccagcgacggtagatacaaaaataacgagaaacttctatgcatggccgcataatgcatatacaaaaatagagctaatgtgagtgggggaggagccgaggacaggtgaatccgtaaatctggctcaatgcaaattgtttcagctgcattttattatatccatcatttgaaacacccgatgatgaattttcgcaaaacattcgacgacaaacattcggattaaaacgttcggcccgagctgggcaggaaacaagcccggcccaaaacactcgaccacaaacccatcaaggtcgggcccacgtgaggtccctcgccggcagtagctggccgtggacaacgccacgacgaccccgaccagagccagtccgctccgctccaccccttgctcacctccgcgacccgcacca

SEQ ID NO: 13350 - DNA, 832 bp, Zea mays
tggcggcgccgtggtgggagctgtgatttggctgtttctctttgggttgtgagatgacggagtggagggggagggggttttgggtaagcaatggtgtgggtgggaggcggctattactggagccgtgcgatgtgtggtggagatgagcgcacccggcttagcgttttatcttgaccgttggattattgcccttccgcgtgtgcgccatccggtccggcgtccgacactagctagccactaggctctgctttgacccacgaaccatgcatcttttttatttgtcgacaaatatttgagaatctagatatacgtgaatgtaaagaacatttttattcctaatgggaacataaaacgtacaacaaaattgcattccagatttccttctcaaacaacaatctcggcgtcacctcgctaaacaagggataaaaatcaactaggatggatgcctggccatgatttgagaagggggaggggagaagatcgagtcagtcatgttggaaggacagctataaaaactctggccatccacattgaccgcggtaatccaatccaatccaattatatttcggaagatcaggacatgctctctctgcactgcactgctgtgtcataccgcgattcaactgtctgtcagcacctgaaaagaagcaagcaccaggttaagcatgcagtcttttgtgggtttctattatcacccaccaatctatatgacctcacaaagcaatgcctgctccacgtaatgctccatacaatccagtaagcagctatgcactcttatgcagtattcagggcctgttgcagctgagcaaacgaagatggatggatcctgccg

SEQ ID NO: 13351 - DNA, 1419 bp, Zea mays
atataggcaagcaaacttattttttgatggtatatatataaggagtaaacttagagataatgggtggtccaaagcaaattctgtgaactaagctttcttgtatttttattacaccgtaccctgattataagctgttaacagattcaacctgaccagcatatttgattggctcgagcaatgattctcaacctgcagcaaccatcgccccatcgggttggatgctgactgtcgacgagccaaatcgtgcgtggcacgttcctaatttttaatctatatcaaatcaaatgttgatgttagttataagtattaaataaaatctaattttaaaattaattatacagatatgcagatatgcactaaacggtgtaatatgaatctaataaacctactatgtatttagttttataatttaactatatttaatactcgtaatagtcattcaaacatcttatatgatacatactaaacattggatgttttaatgaatgaccctaacctactccttgtgtcgactaaaattaatttttttattaaagctcatttaaatgcactatagctaatagttagtttgctaaaaaatatagtgaaattagttggctaacaaatagctagctaactattagctaatttgctaaaactagataatagtttagctattagatagactatttagatgtcgtcagctaattattagctctagcgcaatcaaacatagcctaagtttttgttttaaatttctagagctaattattaattgactaataagttgatagctaaatttgctagttaaccattagctaataagtagaaacgaccaagagcaatttggttagcaccacatattagctggtacggttttaactgagtggaggtagctaacaactagtaataactatttaagaatatagctcacaattaaccggtccattartggacctgttatatacctctcataaattttagttgttagaaattgttagttttagaagtttggaataggacctaaattaaaggaccccacagctacctctgaaaaaacctataagagcaccacagagctcagaaggggggacgaagtggggcgcctagcttcttactagttttttttttccttgcgcaaagcttgcacttgctgagagagagggagagagaaatccagagataaaggcgcttcattcattccctctcctgctttctctctccaacccatccgtcctctctctccacacataaaaaccaacgaagcgggcgagtgatcaggcagaggcagcaggcaggaaataaatttgaagaaagctagacctctgatcagcaggagctcatgggcgccatgatggcctccataaccagcgagctcctcttcttccttcccttcatcctgctggccctcctcgccttgtacaccaccaccgtcgccaa

SEQ ID NO: 13352 - DNA, 1500 bp, Zea mays
tctcactgcatgtccggtggtggcaccccatgccatgtcactggcgtgaaggagttaagatctgtggatgtggccccatgcacaactgtatggaggccagctaagggatggcagacacatccgagtttctgcttgggtatgttaaggacatgcttagtagctccaaaaaagttgtctgacataagaattagaaaattaaaatagttaccaaagatgacagatataaatgaggaagggccacatccttcagccacaattgatggtaaaaaagttgtctctcatcaaccttgagcaagtaatagtaaagcttatttgttccaattaaatagatgtcacatgccagtgattggttcatagtaaccttgtcacttatgtctttccttttatctaatccataattcttttatttaaatttccattactttgaagtcgctaggtctgtgctctcagatacaactaaacattcacacatggctttacctttcttgatctacacagataaaataaattaaaaataaggcaaaaagacaacactttctataggctgccaatcaggtgaaaaaaacaggtaccaactcaatttggcgggttgtgaatctaaatgtaaggtgaacgagcatcaccatagcagttgaagtcaactacaatgcgctacctctgagactaatattacctcaaataaaaagtcataatctacaagatcgtagtttttttttttgctatccgactttaaagatttcatatatatacattttatcatcatatgagttcatctataaaagttatagattttcaagataagttgatagagaaaataaaattctggcaattcatcgacagtaagtatttcccgttggttcatctagcggcagttgtataattttgtattttctttatttggacaaatacttttgcaaaaaatgtttttataaagattaaaaaaactcatacgtacacggtagtctggcccattaaagggtatgggcccatatgttctaagttctaaccctaaagtagcacccaccaggccgcagccctcgctcagttggccggcctcgccttcgcatccgtccggccgcagtcaacctccggttcggagttcccattccccaccaaccaccgtctccatcgcaccgtcgcactgtcgcctcgccggccgcacctacgccgttgaagtcgctgtcgcagctgcaggtgcgggcaacacgtgacctctctcaaggttatcctatctttgtcagtccgtattgtattcgtttgtttcccccacttctttttgtccggttctattcaatgatgcttctgggccataggctggtgccactagatttttggagtcttcttgctaaatcagggataagaccgccttgttgtttttgtgcctcgctagatcgttccgtaagggcacccatcgtcatagatacgattcatagcttctgccactacttgtgcgcgaagagccaagaaatgcgtcaggggttgtgaagggaaggagtgccg

SEQ ID NO: 13353 - DNA, 1373 bp, Zea mays
tttagggggggcaaaagccaaagccaaaagtcaaaccaaacacaccctaaaccctcgcgtgctctcgtktgttgatccaccagactcgtagcaagcaaaacgcttaggtctctcctctctttaggatttagggtgtgtgcaatccgccactcggccggggagatttcctctccgacatagatatatagaatggtggcagagaacatgggaatggactgtacgcagggaggaaggaatcggaaaggcagaacagagaatgggcagaacgtgaaatggtagactactattatagtcttaataagtagtagagatatactgctgtaaagaagaagaaatgatgaataacgcccaaccgtgattcttctttcttctagtgcgtctgcctttgttgtatgattcttcgagttctttttattgcaggtgcaaggtgcaggtgaggtcgtcggggccgcggcgctgtgtgcggccagcgatgaagcagcggytgccgtcccacgccgtcgctgtccacgccctcctgtgtgtgtaggcctgccttgcaatttgcaaattgtatacaaaaacagattgcaaaggctaacgttttggtcggcttccttcacttgttggctagtacgtatgattctccatgccatgatccacctctttctgattgctgttgctccatactcatcagggtggtgactggtttgtggctatcattgttcattgatcgatcaagggcttattagttagcatactaaatagtggactagtgacacaactagagacagctagatgagctcacacaggaaaaggaaaaataaagcaccccaactgaaccacttctctgtccgtgtctaccgactgatgagtgagggccacaactttatttccagagctatactatagtcatgtatatgtatatagtccatttaaatacacacacatagataattcgcttttatgaaaacataaggctggccccaatgataatcctatcttatcaccgtacctgttatggttaacatatgttcttcctaacacccatgttgatgtactatcagaatttctcattatataataatcaatccccttctgccatgccatgtcgtgggtggctgatgaggccacagaccaacaatctaagccacatatatagatacaaccatagctgccatccactaaattaagaaaagcaaacaaaaattaaaccatatcatcatcatgcatccatccaccgccaatctaatctttgctaagtaggtttgcggcccgctataaaaagctccggaaagccatcccctcgcttcacactcacacagccatctctcccagtgtcccagctcagcttagcaatccgtctctctatctacaggcgggggaattaatag

SEQ ID NO: 13354 - DNA, 1247 bp, Zea mays
ctccatcggaagtgattacgtaggcttcgctctttgaacatctaacgaagacacgaagtgatgctcctatcttcactattttttcccagaatataaacaaaataatttctgtagataataaagagatcgttaattaactttgaagcatcgagaactgcatttatccgaagttgaaaagaggatgaagaattgaagagctaagatgacatgcttgcctaggaaggaggttctagagcttagtgataaaatggtaggcagaggagaaacacgtggccaataaagtacaggagaagacttgtatgtttttgcaaaccattgaaaatggaaggaatataacaacaacaactgatggaaaaaaaagaaggacgtttccgttgtgcgcgtgccgcgtgcggttatctcctcctgtcgccgcctccacttccaccatcccaagtgctccctctcccgtccctcagtccgctactccgctgccggtgctgcatcagttaggtcagcggcggcgccgctgatcaggtcaggtggtgcccaggccgttcacggaccgagccctcccgtcctcgtccgacgcgagggcaatcacccacacgggacgccttccgaagcgacacccctcctcctctggccaacgtcccagcaacaacgagtgagcatccactccgacttacattggcagattcgattcctctagttacgggacgcatgctcaaatggattgctaattaatgccgttgtgtgggggtgtacattactgattgatgagtatacattacctgagatgccgtcacgccacaaacttcctcactttactcaattactcagtgtacaattggtgtgcatcaaagtggatttggtgctgtgatttattttcccttcatcgtcatgtgctaatccataggaaagcatcgcagatcgtgctttatttctctggaataattaactgttttcttaggaatggtagttaactgtttaaagaggaatgcgctctgcttcgcatctgtgtccatgggcgcaagtataataatgacgccatatcaactgtacagagctggctgatgagatatggatcaactgcttccaagacaagctcgccttcaggtatcgaagtcgaaccaaaggaggttgaagccatggttcatcctgttgcccattcggtcctttgcatacgttccatgcacacaacacagacacacatatctagttgctaatattgttgttttcttgccatgttactgtatgtagacatg

SEQ ID NO: 13355 - DNA, 56 bp, Zea mays
aagggggtcaaacattttggtaccagagttaggatggaagacgccgccggcaaaga

SEQ ID NO: 13356 - DNA, 539 bp, Zea mays
catttaatcgatgtcagttagtacatagagatattatttgtagcattataaataactcttttcttcattttgtcagtttcatttatttcatttttttctataaataaatgaaattgtctccgtcgtgcacaccatctccagcaagctatattcaacgcttcaataataccaaaaaaaaaagctagaaattaaagaagtcatggccgtcagctggcctttctggatttacctcctatttttgtcagctccgttcttgttttccgccgtttcatcatggactaattaagctaagccaaactgttggatccctttcttccttgaaaaccgcatcaccttcaggtttctgcacctccaggaaccccattcttggcctcgccattatccagcttcgagagcactggatcctttggttccaactgcattgtggatttttggtgccgttgatcgagccacgcgtgcttgaggcttgagcagttgaacacgcggggacgcaggcggcaggctagcgcacacccgcgccgtcgcgacgtgacccggcg

SEQ ID NO: 13357 - DNA, 603 bp, Zea mays
tgatagactatattttaataaaatacaaaaatgtatcatattagttagatacatgtaggcgtggaatcaacaattaagatttaaacctccactcgtgcaaaattctacgtgtaaattaaaacatgatgatccatattattttttttctattactacgttttcccgctgttcgtaattttcgatttctgtgggtccgtttattctgctcccgtccaacttcgcggtcattccgattctgtttccgttaaaaacagaagtagaaaaagggtgttttcatctgttttcgtcgctacctggtggagcccgcaaccgcaacacgagtgacgagccctggcccctgggtcacttgccttccgcacccgtcccgtgtatacttcggcaacccgctgtcccatgcgctcacatggaatggaagctcccgcacgaactcgaaccaccttcgcctcgccacctcttcctcttccccagtagccgccgtcacccacccactgcggcagccaaaccacgtgaggccttccacccagctcaagcccacagcatccactgacactgccaccgccgctcacctccccggcgttcccggctccaccaactactgcaagc

SEQ ID NO: 13358 - DNA, 700 bp, Zea mays
ggtgagctcagtatactctgcttcttcttcttccgtcatatcgatctttgatttgagattcgtagctcagtacctgttttgtgttgtttacttgtgttgattttgcttgcagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccac

SEQ ID NO: 13359 - DNA, 900 bp, Zea mays
ggtctgcgcccgctgccccacaccctccgccccaattcacaaaaccctagcgacctcgatttctcaccggcatggtcatcaacacctatctctcagccaccacagccggtggtggcctatgcagttccagtgcgcgctcacggctgcaccgcccatgtcgatccccatcaagaagttgtcctggaagaagagcacccgcatccgctggcctccaccgatgccaccacctcgcctgtgaaccagttctcgttgaggtacatgacagccatgtcactagctgtcttgctcctagatcttagtttattgtggtcgtttatccctagagtttaataatatgtggatccctgcaaaatawttctcgtttgtaatggtttgatctgtagtttctttgtcatttaagttccacttctttcactgcaagaagatcgcctgttgcttttttggagtagcactgagactgaaattttcaccctcagttgacttgttcattagttgtaccgtgctactgtctgcagttcacccatgtacttctatgaatattgtttgattttgtttagagtatattacttatgatcccattattgtagtgcagtgacctgaaaatgagtgaggggatgctactcagcttgcccttgagaaaggatcaccgcaagtgtctactgatgatggttcgagtagtcctgcaactgtgcacaagttgaaagttgacacagaagatgctggaagcaaaattgaatcacccactccagagaagcttgaatctagaagcaaatggattgttgtgagttcgttggcaaggaatttacttgcagagaggtacaaagatagatttgcaaatcagttcctggaagatgagggtgacatagatgatgaagactataatgacagtatttggcccaa

SEQ ID NO: 13360 - DNA, 1159 bp, Zea mays
tggggatcgagaggctaaactagaactactcctaattgttctgaaaataaatacgaaatataagtggtattggttcgattgttggggttctcaatcggtcgtacccttttatatttattggggaggaggtctggaccttttcctaagagatagccaacaaactcccacgtgattagatgtataaccacgcacgagataaggataaacatccgagttaatctaatctcgggacacgcggaccgtccgggccatggacaggatcgtccgctcattttagtgtccaacaatcattataaacatcttaatcacttctatatcacttaatatttttatacttttatactatattattaacattagtttatgcaattttcttaaacttctaagtcgatagtataaataagtaataaattatatttgaatggtaaaaaagagactaagagtgtgtttgttttcttctagattatatataaattggattataggggaatggtacggagtaaaacatcactttacgagcataaataagctgaaataagctagtattaagtaacttattttagcttatttgtgatttcaaagtgatattttattcccctacatttttatcataattcaacttatataatctaggagggaacaaaacaattaggagtgaaagaaacagtgagcctaaagcgatcatcgttgtagtttattgtgtctatatgttatttacgtttacgatagatttaatttgatttatctattgtccgtatagtagttgctctaagaattaatttaatcatattgttttaacaggaagtgttattattgcacggattggagaggtggataccgtggcaccacccgccaaagttgacataaacaatttctcctgcctgccgtcctcgactcctcgtcgtcttctcttctccgtcttcgtcttttccaagtccacggcacacagcacgcagtcacaataacagcgcacaacccaaccaggccgtcatctttctcctctctcctctataaaaggcaagctagccccataatcctccaaactgcattctcgatcatcggctacctaccagctcgctgttcttgctgaagccctggagctatatagcttcgatctgcgcagcacaggttgtctgtcgactagtgattagtgaagaag

SEQ ID NO: 13361 - DNA, 1500 bp, Zea mays
aaacggcctgctttctgttcctgtgcgtacgcaccccgcccgcgccgcagtcccgactcgagtcctgttggttcatatccccgtaaggctagaacagaaataacttagagctcggaacagaaataactgagagccagataggaataactgaggtacgtagaacacaataactgagttgtcacaacagaataactgagtatgcacaacagaaataactgagatcctgtaggaatcacagagtagcgagaacaaaaataactgagtagggagaacagaataactgatgaataactgattagtcagcagagaataactgagttcygagaacaaaaacaacggagcaggtagaacttgaattccttctttttcgatttcccatccttctcctgctgcttcctcttcyccttgcttgtgttgtgcaaaccaaacctccaattctattcattcatttggctgcctcatttttaaaacaagatgcacctctctcgcatgtactacatatttactctgatttgatttatcataatgtattttaagcatagacttaattttttttttcagattttgccggcataggagtacatcttttcaaagctaattattaggtgcttgttggcgatagacggacccatcggtctgctcatcggcggccccgaccatcgcatcaaatattttgactagagcagaggaagtgaccacggcgcaggtgctggatttgtcttccggttccgagggcgaggtgtcggcgcactcgcctgatcccaatcgcccctctcagaagccgggtgtagatcccaatcgccgggttggcgacaatggttctagcgccgtggacagcctcttcgaggaagcgggcgcggcgaggccaccgcgtcaccccaacaacgcgctgaacaaagggaaggagtctcggrtcgtcgatgtcgatgtggagagcagttatctcttctccacctctctctctaccaactaagcctatggctgtgggggataaccacgccggagaagacgacgaaccgcggctacaaccttcgtagccgagggcccccgtgctccagacgcccaggcccttgacaatgtattaatagactgagttagttgggtctggcccattacataggggtgagaaggtaaatacatggggtaaaccccaaaccctaaaagggaactctaacagatattacttattcaaaatacattactaattacattttgttgcaatctttgtttattattttggtattcaattttttgagttatggtcatgtttaggaagttgaatatgtctgtacccggttaccatgtctaccatagggaaacaatcatttgtaatttgaacaaatcctggtagtaggcagtgctttgtttgtttacacattatctttctccattcagttacttgcagtttttagccttattttttggctttttttagtttttcctgcataatgcttataagataaaagtgttttatttctcaggtcttggttaagtttgaag

SEQ ID NO: 13362 - DNA, 306 bp, Zea mays
tgcggcgtgcggaccaccacggtcataccggcggcgtgctgcggatcgcgcgcctgaaagaactgagtcagctgcgcgctgagatcggcggcatagccgggcgtcgcgaaggccagccacagcagggccagcagggaagaagttgtacgcatcaacgcctcctgtcgaaaagatggcactgagtctactccgcgcaccaaaaattcaaggtgaaaaatagccacgatttttgctgctattcagacgatagcccttgcttttgtcccattaagctgtcagctcgaaattctcattcgcggaggaagc

SEQ ID NO: 13363 - DNA, 627 bp, Zea mays; identical to SEQ ID NO: 13340

SEQ ID NO: 13364 - DNA, 1410 bp, Zea mays
gaattttagaagaatcatacgttttatatgaatgagtttatttttactgaaaaaataaagaaacgagaaaaattccgactttcaagagggactaaagttcaggttattcacacgctactgccatcaccctcggtatacccctctctcccgcgttcttcattcctaggtcagacggacgcgcatccccgcaagcacgttcccgtgctctcgcagctcgcttctccagaggcgactagggtttgaaggctaccgagagggtgctactgggccaactcctccgaccgcccgcaggcgaaggagctctccgccttcccgccctcgtgtcatccttcccatcgcgacccgcgaggccacgagcccacgagctccagctcttgttattcggaagggttctggatttgggagccaagcgactggcgcagcggcagagcccggcggacacgctcccccctgtcgcccattctcttcctccccgagcggcacccccgcgtgttgccgcttgtagcatcggggaggtaatatgttctctccttctagtctatttaatgatttaatgaatgttgatattattactgaaccaattaggagaagccaattgaattgtaccatttcggtagcccctgatgggagttctttgatctgagtaagcacttctgcagatgcaccggtctatagtttgtaatcaaattagcatgatgaatggaactagtatcatttctgagaatagccttgatacaaccgattgtggtcagattgttgtggtagcacttttctgatgataacttatgtttcgtgttattccagtttctgtatcaactaaggcttaatcaaacattaatcttaaatttggaagcttgcgtttaaagatggagaaactgacagtaaaagattgaagatcctcattacacaccagaaatgttacaaaaacagcactaactatgcgaagctagtaaccgaaacaaagtgaccatactgctttggrcatcatgatcttttaacagacaatcaaccatgtgaaaatgactgcccaaacagtgaaattctccatataactccttaaggccaatgctgctacgtgcagctagcttctcagaagagctcctcacaaacaaactttcacaaacagggcctttgtcatcttgcttgacctgttcacaccggtgtggggtttggttgactggttttgttcagttgattttcaaacaaaacttaagatgaaattgagtggtaactatagtctgacttttttttggttgagatccataaggatttacttagataaattgtgtttgtcagctttggattgcgagtgaatgaattatttttcatgtatgtacatatttggttttcgcactgcattttaccaggctgttaatgccatctttttacagaaaaatacagaggaaggac

SEQ ID NO: 13365 - DNA, 62 bp, Zea mays
gttcttgagacgctgtgaggaatatctatactgtggtggctttttgtgctggtaacaagata

SEQ ID NO: 13366 - DNA, 1500 bp, Zea mays
taactgtagcattcttgcgggatgaggatcctccgtgtcgactaggacccatatgcgattatgcatggagtctgtgctgttggattgggatcgtctgccttcgccctctaaaggttggatgaatcgaaacatgatgccgcgggaaacagacgaagtggagggaaacgacctgcatttattgccgtatggagggaaaatgcctccttgctctgttttggcaccagaaacctccattctgcaacctgagcatcatctcttcttccttttctctctctcacattgagatataacatccctaatggaagaagatccgaacaagaattatcaagaagacaaaaggcaaataatacaacacccatacttattcttcttctgatttttgatagtttacgaagaacaataatattgtgcaaactgctagcttgttatctgtttttagacaatatacacctcttgttaagaatggagaggtaggagatgatcccggaggcagcatgtcaaagatagaactctcatgtttgttgttcttctattgttttattgctcataaggaaaattgagaccctgctcttgatgttttagacatggcgtacttcctgttatggtgcctgaaattggcatgaagtttcaggatgaggtagagtcttggaagttttgtaatacatatggagtaacacggttttgaggttaaaaagagatatgcaaacaaaagaaaatctgttggaatagtgacatcatttagatttatttgtgcaagagagggtcagcggaaaataaggtaaaataagtcatcttgtaaacggccacgagctaaaactagaactaaatgtcttgctgtattttgaactaaatgtattattgttctatatatcttttggagataaaaatacgagcatgcagtcaatctcagcctgcatttagtttcaattaaatcttggtactattttttttgtttatttaaatggtttcaactccatacttgctgctggaatgaactagtttgatcccaatttattggccttgtttatgtgtatgtatacttgatttattctgttccagcatcaaagcagagaaatactgtcaatctgctgccaaccgttcgattcctttaacggtggagagcagctaactgggcactcctaccttcgggttcggagggagaaggcaggcgatcccatcctgtgctgttgccccagctgtgtgtgatctctcctcctcgtatggccgtacacgagctctatataaacagaaacaggcttgcccctctcagcacacgcgcctggattctcctcgcccctcgcctccctccacctgcagagagcgccacaaggtcctgcttcaaagactgcccaacgcccctcttctcccatgccgattgttcctgtcaccttcttaactcgtttgtttccctcctcttgagccactgaaacgtttacagagcgcttcgttctagcagcagcggacgagggagacaagaggaggaagagatggcaggccgtg

SEQ ID NO: 13367 - DNA, 1500 bp, Zea mays
tatacccgtcaattgcaagacaccagttaacctcaagatatatcaggctagtctttcagagatgttcgtaaatacatgatatctaaacatctatgattgtactacattttagtaaaaaggcactttaaattatttctttcaaaaaatcttaacaaaaataaaaagtaagtggacaatgctcaaacaactaataattaatctattccttttataaaaacaaaatattttgcgtcttattaagatccaaagggcccattttattccgtgcctatgcaagttcgacaatatagtgtgaaggctgattccaaaataagtttactaaaaaaccagcttatgagtcctttttcaatggttcagtaaaatttggtccatagaaacgtctgataacgcggtttttgtatatggttggatgtaaaaagttaaaagtagatattggactgttagcacttagcaggcttattaaacgagggcacagtatagagcccgatctcaaaataaattaaaacacatgtttataaatctttaaaactcttgtactatatgagttatctacgcacaatatagagtttaattatcaaatggagtagaatatataaagttaatgctaaataaatcatcaaaccataagtcatctaggtaattatacaacaaaggtaaaatgttcgttacaaacatatacatgtttgcttcgatgaataaatctatattttttgaaaagttgtgttatactccttttgtcctaaaaaaatatagaaatgttcaaaattcaccacacaacacaaaagacacatgtagctttacacttttcattctcatatatactgacaaaagaatatcaaataaatgcacataaaaactatatattttacatctgcatttctatataccacacattgttgtatcacatctattcttaaacactagcaaagtgcatgttcattgctacggtttttatatatacatatataatataaaacacaaatacatattagcatgagtgtgtgtttgagcccaaaaatcatgatttgaatcaacatttatgagctaacagtcaaggtttaaactttcacctctacccaattttatcttagagaaagattgaggtatgatgattttcgaaccgtaaaactggtgtaacaaataatgcacacagtatatttttcggcggtaaaaatccgagaactataatgatacattttttcgttctttttaatttgttgtgttttaattgaaaataaactaaccactgataaatatttgagaactaacatattacgtcgtaccatgcgaacaaacaagctgagaaggtacaaaaatccccatttcgatcaaaaagagtccccccccagagacacggaacaacccctttctttttcttaattcctcatccactcgccgcacgacgaagagagcggctcccattccccaccacctactcggaccggagcagcagattctcgaagcgaccggtgaaacattctcgcgccaattgtgggggcc

SEQ ID NO: 13368 - DNA, 1500 bp, Zea mays
aagcatagaccgccaaagaaccaacatgaatttctgcaagtctgttaggataccagtttgcttgtgttttccctttgtgtgggcgaagcatctcgctcggcattggtggagctttgttgtaaatttgtaccctcatcgcgagagaaaaaaaacaaaaacaaacttgcaagtgtgtctgggtccttgcaaaattgtactatttggagactgtaactacattgagacagttattttacggagacaacatataatataacagcctgtcacataggtgtaattatgctgaaataatgctatggagctagtagactagtgatactagtgtatgtagtatcattactggtacagacaaggtttggtttaccaaattcagtgaccttatcatcatcaagagtacaacaatcgcagacaacttattgaattttcctaaaagtgctgtgcaaggggctcgctggcaaaaattatgtgccagcaagatccagatcatctaatgttaagtatcaagaatacatgcctagggctggtaatggatcacgatctaaatgttttttcacaatttgtttgaacccttaaataattttagttaaaaaataaataggaatatagtctgatactaatctgatttgatccttaaagtttgtagtataaaatattgagttcattaccacctctactctcacatccaccacttagaaacccacaaaaatagaagaaaaacaaattgctaagacgttaagttgcatatttcgatctgttttttaggcctacgggtggtatatgtgaggaactatgcgtttgtatccggcatgtatataatttttttttcgcaaattcgttacaagagccagttttctaataaaaaaagaaaatggaagttaggaaagaagaaagcatgcacatcaaacatcatgaactagagaggcgtaaactatgacgtacgctttcattactacgatgtgaaatctccttgcaagcgctttcagttgcgttctcgcttctcttctcgtggatccccaaatcctctccggccaccggcatcgctcctctcccgcccgccgacgccgaccgctcctatccacgccaccgcgtcggtgctcgagttgcctcagagagggagagagagagagagagagggagggagggagggagggagggaacggcgctcacgctgttccgattcgaacgagctcgcccggcgatttttttttttcctggaacgggctggctccgaatctcggcgaagtgtggggagcggctccaccctccaaccaagcaccggtacgaacgggattgctccaccccgtcacccctcatccctccattccaaccaggcgcatccttagatcggtgaccgaaccgcttgcctcgcagcaggatcaaccagaaggcgggcgcgcgggcggcaggcggcggtgctgagaacacgggtggcactgtctggacggacgctgcggatctcggcgattcttcgcggcctgcgtcaagggcggatcggcagcg

SEQ ID NO: 13369 - DNA, 1043 bp, Zea mays
ccgagagaagggagaaggactatacgtcgcttggttctctccttgttaaatagggtgtctagtattgagatgataacgagtacatacccgttagatagtaccattctatatccgtacccgctaggaaagtcttaaattacaatatatcaatcactcaaaatattaaataaacataaaaacaacttcaacttcacatataacaaatattacataacttggtatctagacaaatgatagctagagaaggcagaagagttttgttttagctaaaataggctctattagatggttatagtggaactagtgcgggtatattttatcaataggtagaggtttttactcattaaataatcgtgggtaaagaaatcatctcgtactcgcctttatatcgagtaaaatccgtcgaatattcggatttcgggtacccattgacatctttagtctaatatattctatataaaaattatcaatgactgactagtgtggagaggtgcaagttagagttcctcaagttcccccgcgcttataagaaaatatatgaatggtgtgtctgctgggattcgtgccttggtctaaataatgtagtttgtgttatataaagaattcgtgtatgataaaaaaaaatagcaatagtaaaaatgggaaaacggccgcggtacgcgtccaccaaacctaacctgcgaaccgcagcagcggaattgcgtagcgtaaccatattcgtttgtgtcggattacttctagaattattttaactaatcaaaatttatataaattaaagaagcaatccgattagaaacacaaaagagcgagggctaaagcggctcatcggagacacgacagtagtgacgagactgacctcttctcgccaagaagtaacagaaaaacgcagcccttccttccttgcttcccatgctcgcatcgcgtccttctcttcccgacttcctcgcgttcatttcttcaccccacccgcccccaaacgccaaatctaacagcaaaggtccggaaccttctagccgcacctagggtttggattggcgccgagc

SEQ ID NO: 13370 - DNA, 1345 bp, Zea mays
cgcaccacacgactttatgaaacaaaaagctgctgctagccacctaatctcataatccgtgcgttgccaataggcaatagggcccgtctcgacaatgtcgtaggcaagcaataagggtctaccaatctaatccttcagacaacatatactacatctcgtcgttctggctctagatttttatgcccatgctcatatagataattactataaacctagacatatatatataaacatatatattaattattgtatataaatctagtaaaaatataaaataaattttaatttgtaacagagagagtactatataatactagtctgcttcaaaatacagattttactatctctatttttccgatccacattcaaatgaatgataatgcacgtagatatacataaaaactatatttatagattaagtgataaatgtatgtttagtctaaaataaattatattttaggagtatatatatacatatgttcattggccccggccgtctcacgggttgaccactcgtttaagactatctcatcaacttaccaatctttatactcatatttaaactttactatacgaagaatataatctatagcacagaacaatggaaaaaatatttaaataaactatagataaactgctgcagacatccgaagactgccgttcccaaccaccggaccgagctgattatggcagtgctgaagcaaacaggaaaagttcatcacctagtagtagttgttgttggactggaagtaaactgacgggacctttcgtaatgacgccttgtcgattgcacggttgccggtggcgttggctcatcggctctgctcatgcccatccatccaccacccgctaccaacgctccatcacaccaatgtaccataagttgacacgggcgcggccgccgaaacaaccgccaccgcagcgacggggacgggagctgcaaccaccaaaccgccgatggagcggcactacaactacaaacaagcaagtgggtgggagcagggcgacgcgtagcagcgcaagtgcacgacacgcgggctccaccgccgcaacccgcaaccaccacccgaaccaaccaaccaatccgtcaaactcacccggaaacaccgttcagaggtggggtggggtggggtgggggtggacgcgagcgagtactgtacagccagcacaaacactgaaacagggaacaacacccgagctatagcgagcacggcaagtactgtacccagcagcagccacgtgccatatatataggacctcccctcggccgcgcgccttgccattcgtctgctctcgaccgatcggcgccacgagtgctttgctttctggctgctgggagcgcgcc

SEQ ID NO: 13371 - DNA, 382 bp, Zea mays
cggttggttttttgttttttcaagtctaagcagactaaaaagcccgacaaacagcctagactctgggactactgtaaccgccagtaactgctacacgcagcgggtagatacacggcacggcagcctgtagactgcagtcagtgacacgcaacgcgcgcaaacgaagacaccggtccggcgatccccctctctccatccggacgtgttgctgggaggaaccgttcttccgacgcacagtaaccatcaaggacaaaaaaaaagtaattactaataacaatcacctctcactctcgctagttactataggtatactgatgttgcggtactgaaggtactagatgccgcggcggccggcacgtactccggttgctagtcgcgatta

SEQ ID NO: 13372 - DNA, 590 bp, Zea mays
gggctgcatctaggttgaaatttcactgggaaagcaaaagtgagcaagtgattgcagttacaatcaacagtttcatatatcacatgtaatcaggttacttttctttctcttactttttattgggatgaccgaattagtttctggtcaataattatttcgcatcaactgaaaagtgttgtttaatagcatcattgcatatgattatacagatgcaatgatcacagctcattgttttgaagtaatcattttgtctcaaacttacataatgtgtccatcagtctgaagtatgaactaaaacctatttcttttcagaaatatacctaggtatgagcttctgcgtgttcctgacgaagtcgatgcggctatggagctcacggagggaaaaccgcaccacgaggcccatgcgtggggcggagcaccgccgggtggaggaggcgctgctggcgagcgccgatgaggaccaggcggtggagaggtgggaacacgacatgactactggcccccggcgacgagggaaacagaagcgacaaggagcgggcggaacgagatgccaccacaagtagctccttgccgccacctccaactttgac

SEQ ID NO: 13373 - DNA, 1301 bp, Zea mays
gaagagatgagaagcacatgctacatggtaaacgtctgccctcctcttatcgataatgggaaatatacattttatagtccgtagatttgataagcactcccttacaaattcttattcgactaatgtttatctatagataccaagtctattagaccggattagctttcgatgctaagctcatcgaccaactactattgcaccaatctgatgaagatttggcggcaacattctcattctgataagagaacctcgctcataaacccccttttattcttccaataaacagtgtcagtcgttagctccttcctcctcgtaccaccatcggcgcaggccgcgctgcactgaccgcttagccaacgaggctggggcaagcatcttagggatagtttgggtactccattattgaccttaatccacatgtattgaatgaattggggtgtaacttaaaactaatttacaccctaatccacctcaacacatgtgaattggggtaaatactagagtatccaaacaaaaccttaggggtctatgagggtggatgggaaaagtcacacgtaagagaaaagggaaaaaaagaaaaataaactcattttttttcataactagttacctatgaataattttcatgaatagctaaaagagtgtggtttcatgaatatctaactggataattttcatgaatatctaactggataatttttcatgaatagctaactgaataatgttttataaccagctccattaataagagcgtggtttcctaaaaaaaatttgccatggaatttcattcaggcgagaacatggcgacgtccgcgacgcgtgtaggtagtttggccagctagtagggatcggatgagaggacatggctcacatcgattattcgttgtcattaacgtaacgtggctgccattaagcgagctgagcagtgcccatgctactgctatatccatcgtagaggattagagcatcgcggttgtccttgaatcaatgcactcgatcgatcggtctcctggctaactggatgtgatggacagatggaggctccatccatcatcacctccccatcgtcatcagcggcggcagcctttaggggcctcacatgacgcggcggtggatggttggtcgatggagcgtgagagagagagagagagatgaaggaaggaagggatcggccgccgcacgaggtgagagagaggacactcaaacgtgagacagcaataaagaaagcaagagctcggctctgagtggccccgcacaccatgagcgacaccgatcaatcaatcatgtgatgcgttgcatag

SEQ ID NO: 13374 - DNA, 206 bp, Zea mays
ggtggccacactcctgtcatccgcgggccaccgcgtgacggcgctggacatggccgcgtgcggcgccagccccggggcgcgccgaggaggtgccgtcctttgaggagtacagccggccgctcctggccacggtggccggcctggcgcccgaggagaaggtggtcctcgtcggccacagcttcggcggggtcagcctcgcgctggcc

SEQ ID NO: 13375 - DNA, 291 bp, Zea mays
actgccgagaaggcccagcagctgccgcactgcccctggtccttcacggcggtgacggctccgtggtctctccagtcccacgcgtcgggcgcgtcgccgacggaggcggccagctgcggcggcgactcgtcgctggacgacacgcgcacgccgctggcgagcctggcggcggcctcggagtcgacgaccttggcgcccgtgtacttgctgacgaactcctcctgcgtcaggtccgcgaacttgttgaggccgagcttgtagggaacgtctttcctcttgttgaactcgccg

SEQ ID NO: 13376 - DNA, 1316 bp, Zea mays
aaagggaaatgtgcccttgggccatttctaagtattttggtgatttagtgtccaacacaagtgcctaagtgttaaatggtggacaaagtacaaatcgagtataaaggtatgtttctcagacttagtacattgttttagagactaatgtattgtgtctaagtgctggaaataggataatcaagttgaaattaaagatggctttgttcagccaaagtcagctctgtctgggtgcaccagactgtccggtggtgcaccagacagtgtctggtgcgccaggctgactcaggcaaacttgctgctctcgggaagtgattaacggcgtacggctataattcaccggactatccggtgtgcaccggactgtccggtgagccaacggtcggacgggccaacggtcggccgcgcgatccgcgcgagacacgtggccgagccaacggtcggaagggggcaccggactgtctggtgtgcaccggactgtccggtgtgcaccggacagtgtccggtgcgccaacggctccaaagcgccaacggtcggcttcgccaataaggaaagagatccgcaccggacagtgtccggtggtgcaccggactgtccggtgcgccaggcgacagaaggcaagaattgccttcctggaatgcaatcaacggctcctagctgccttggggctataaaagggacccctaggcgcatggaggagtacaccaagcattctctaagcattcctaagcaccaagacttcgattccgcgcatttgattctttgtgatagcaattagagctccatttgagttgtgaactcgccgggttgtgttgtgagctcttgttgtgacttgtgtgcgtgttgatactctgatttcgtgtcttgtgtgtgtttctcatccctcccttactccgtgcttctttgtgaacatcaaagtgtaagggcgagaggctccaagttgtggagattcctcgcaagcgggatatagtaaagtgaaagcaaaacactgtggtattcaagtgggtctttggaccgcttgaaaggggttgattgcaaccctcgtccgttgggacgccacaacgtggagtaggcaagtgttggacttggccgaaccacgggataaaccactgtgccatctctgtgttgatctctttgtggttatcgtgttgtgcaagttctcctctctagccacttggcttattcgtgctaactcctaatcaagttttgcggattaagtttcaagtttttacaggatcacctattcaccccccctctaggtgctctcaattggtatcagagccgttctcttcaagaaagggactaaccgcccgaagag

SEQ ID NO: 13377 - DNA, 1500 bp, Zea mays
ctgtaatggcaatagtctgctttttcctcttttttcgtcgctcattttacttgacgtgttttctcctctttttgagcctttctacttatatggaggtattcactattcagtattcaggttttcttgtttgtcatcttaattttttgcacgttttttatagctggtttatggtgctgcagctcatcacattaaagatctgttttttctatgcgttctttagtttctgggaggtttatggcggcactgttcatttctagatatccgttcggtgtttgataaacacgcatctctggaacgttcattcttaaggatattattgacttattctggaaggttcatccacaaggattttagtgtggcgttgttcttgttaattaattttccttaattttttgggtacgcgctgcaattttctttgccttttcttgtttcttggagtcttggaaatttcgccatgattcccgaaaggataatgacgcacttttttcttggcctttttcctggatttattcccattttcaaatcttttgcatttttagggtctatatagtatatagatatataattacatgactattattgtaatccattacatcctcctttatttatggtcgtgttagatgatttaattcgttttcatttgttgatgagcagatttgcagctttgggtccgatacagtgctcatgtgagtatatatgccatatagtttactgttttgtgtgagcatgtagaacgtctcctataatggactagtaggatgtttctgtatgagttttgtcactagaaaatcttctatgaactctggtagtgtgtcgtgttgaggtccgtgtttattactgtttccatagtctgtgagatgatcatgatttcatgttctttttaaaaaaattgtaaggtcacagcaattgggctttgcctacctgcatcattcttacatctatactatacagcgacttcttctcttactgctttaatcatatgaagtattgggaaacaaaacaaagccagatatttaattttaagcattccaattttattgacgttagcgtgggctgcaaaataataaagtatcctgatgttacatttgtgttgcatatttcgtggtgatgggacttcggagtaaacatttgtggtttactgaaatgtataccgtttgcaaaatgtaattagttggcagctgatattactttagagaatgtgtattgttggaggtgtggcatcagatagggactcccattagtggttttaagtttagatttaacactttttaaacagttcatgtttgcaccaacttaattcctagtttttgttgcttcagcttgttgcaatattgctgtactcagatgttctatctctgttggaagggtgattttacctgtatacttgtccttctgctgcttcagttgctttgctgcttgcttgaattatacagctagtgcctacacaaatgtctgattggggttgctttggatacctactcatgcagcaaggctcactaa

SEQ ID NO: 13378 - DNA, 1264 bp, Zea mays
agaacccagggcttccattacctcttccctataaatataaatatatatatatatatatattaagggtgtgtttgttttactcctaaattatataagtttaattatggtgaaagagtataataataaaatatcactttaggaccataaataaactgaaataagctagtattggatagcttatttatgatcctaaagtaatattttatcatcctactctttcactataattaaacttatataatctaggagaaaacaaatagagtctaataatttgaaaataaaaaatataatcattcctgttcctttttatttatcatgctttagttcacatatgaacgacgacaaatattaagaatgtaatattatttaagagaaggttaccaatatggtatatagaaagtgtagtactatacgaccaactaactagtaaactgtcgtgcataaaaaacacgtataattctgtagctttctatccttgaaagttttttttactgtaaaggaacttatggaattgttcgtcggttttctaatccggtggacgtgattagagagggtgtggccgagtaagcataaggtcttgttcgtttgtgccagattggtgggtcggaacgatttcgagccggattgcttctctaatttatataaactttgattagggcttgttcggttagctctcaatccatgtggattgagtgggattgggtgggtttgaatcccaaacaagtcaaacttcttctcaattttttccaatcccatccaatctatgtgttttgggaataaccgaacaagcccttagctggaataaatctggttgcaatccgacgtaaacgaacaaggcctaatccagtgggaattctgggccggtttcgcccgcaccgtgcgggtccgatccacgggctccagacggaagccatagcccgcctacggtgcgtgggccgagcggaacaggtgctagaaataatggcacgcggcgacgtcttaccggctgctcgcgcgtccgtggcggcgtggcgcaacgtgttgggtgggccggtgggcggtggcacgttagcctgccgctaggaaactccgggttctctgttctctctttccttccgactttcccactgccgtgacgattttcacagcgaattctccggccggcgccgccccgtccgtccgtccgtccgtccgttcattccgataccgaactcgccagtcgccacagcgatctctctcgctcgctccgccgacgcagcgctcggcttcagctcgagaggaggaa

SEQ ID NO: 13379 - DNA, 1200 bp, Zea mays
gattaatccttagtccctcaaaccaatagggcctcattttgggatagagagagttggcattgatgaaaaaaaactatttttggtaaaagaaaactttagccacctttagacagtgggatccaaacacctcccaattgtttagctaattttaggtcgcgtttaaattcctagagaaattgagaatgggatccaaaccacttagattctagaatgagattacataatttaattatataccaaaactttattgttttgagattttcattatgcagagacaataattaatttgaggatgacatcaaatacctctgttttatttaaatatagaattcaaattgtacatagaactaccatgagaatgaaaatcaaattgtgtcggtctcagatcctgtttcaaacatttagagctaattataattcagctaataagttgagagtgttccaacttcgaaacctaaagctaatagattgttatgataagcttgatgtctttcctatccatacctgtctttctgataagctaataggtggaaaggatcatgggtaatttgatcatcaatccacctattagctggttttagttgggctgagataactatcaactaatgactagttggggtatagctaataattagctggtctattagttgacttgttctaaacatctcagataattgtagctgctaactattagtttagaggtatggaataggccttagctaagctattagagcaacttcaagagtytctttatattatctcgtagtcacatgaatagggtttatagtaacaaagttcctcctatgatgatttcttcaatctgatcttcagatattctcatccttctctattctaatcttctcgctcaccaaagataaaaagaaatggagctaaccctctaaagtgtygaacgtaaagtagagaagtggttagaggactgtgagatatagagaactgtttttattagaataactcgagtgaaaatttatataatggttaagaaaactgttggataattaggtgctgatcagcctaactcctattactgctaaataagaaaacagtgcaccatgtctcttagccagcgacctatatatatagatcctagctcacagcgtcgggaaaccaaataaccggtaccccgaggtgactacaccgatcgacgaacacaccccatagttgaggccatcaaacgccggc

SEQ ID NO: 13380 - DNA, 1500 bp, Zea mays
gcttgctgaattatataaaatcaaattgctcaatttatctccatactatgctcaggccaatggttaggtcaagttaaataataggacatcaattagcgttatcaagaagaagatatcagatcatcctaggcattgagacagggttttgtctgaggctttatgaaagggaattaggcttacacctatttcctaaatgattttggtggttgaattgcccaacgcaaataaattggactaactagtttgctctagtgtataagttttacaggtgccaaaggttcacacttagccaataaaaagaccaagaattgggttcaacaaaagagcaaagggataaccgaagtgtgccctggtctggcgcaccggacagtgtccggtgcactaggggacttcacgctgaactcctcaccttcgggaaaaatatgaaggcgctccgctataattcaccggactgtccggtgtacaccggacagtgtctggtgctacaaggaagagcagcctcaggaactcgccagcttcgggaattcacaacggctagtccgctataattcaccggacatgtccggtgtacaccggactgtccggtgtggcatcgaagcaacgaatacttcggcgccaacggctacctgcagcgcattatatgcgcgtcagtgcgcgcagaagtcaggcacgcccatgctggcgcactggacactctacagtacatgtccggtgcgccaccggacatccaggtgggcccagaagacagtgctccaacggtcgaatcccaacggctttggtgacgtggctggcgcaccggacatgtccggtgtacactggactgtccggtgcaccatacgacagtcagccccaccaaacggctagtttggtggttggggctataaatacccccaaaccacccaccattcatagcatccaagttttccacttcccaactactacaagagctctagcattcaattctagacacaccaaagagatcaaatcttctccatattccacacaacgccctagtgactagagagagtgatttgcttgtgttctttcgagctcttgcgcttggattgctttcttctttcttgattctttcttgtgatcaaacactcacttgtaattgaggcaagaggcaccaattgtgtggtggcccttgcgggaagtttgattcccaagtgatttgagaagagaagctcactcggtccgagggaccgtttgagagagggaagggttgaaagagacccggcctttgtggcctcctcaacggggagtaggtttgagagaaccgaacctcggtaaaacaaatccacgtgtctcacttcatcattcgcttgcaatttgttttgctccctctctcgcggactcatttatatttctaacgctaacccggcttgtagttgtgattatttttgagaatttcagtttcgccctattcaccccccctctaggcgactatcaattggtatcagagcccggtgcttcattagagcctaaccgctcgaagtg

SEQ ID NO: 13381 - DNA, 1048 bp, Zea mays
tatttgtatgtcgtcacaatatacatgcatcgtacttgaaattacaaagcaccacacaaaaaacaacatttgtatcctctaatcaggcatctgcattttaggacagagaaaaagaacacacgaaggaggcagaggaagaatgcacctgcaggaagcggcgaaggggtgctggccggcaggggctagggcacgaagagagcagaaagttaggtcgcagtagtattggagactgcttattttagattataatctgtagcttaaataatagaaaatagatagatagattacgaaatcagattatgtacggttgtttgattcgctgtctcatttgtcacagtttatcacatttaaagttagataagtttgatcatgttagatgtgtttggtttgtagccacaattatgataaaatttttctcatacttagatccaactcatcaataattataaaattatgacaagattttcttaggtatgacgaattgtggcgtatgatttaaacgtctaaccttatacatgtgtcgaagtgtagcataaaatatgtgacataacactttaagtatagaaccaaatagacccataatctaggggtaatcatttgagtttttttggaaaagaactaccaaggagaaattacctttcattggttacccaaaaaatatttcatttatttttcttactttcgtcacataacacatgactaaaatcaaatactcaaagttctataacatgctcttctattttaaacttcactcaatccgtaaattaaactgtgtaaacctatggacattttctggaattccaaggcgcctaacctttactatccctgaccttttctccgagcgttcattcaggaagctgcccggcgacgcgccgctcccccgcctcttccttgccgccgccgccgccgccgccgcagacgcgcggcacggggcggtgcccgtgcaaggcgatcggggccgtaacgctcgactgcccctccacctcctcatcctcaccccagcggtgagtagaacaaggggcggtggtcttcactgacatcgcccacc

SEQ ID NO: 13382 - DNA, 639 bp, Zea mays
tttattagcagactgctgtggttttatattttttagcattattttgtttttcaacaacccccgataacagattttgaggaaaaaaagtttagtgacctcttgaagttgttctaaaaaaacatcccgtgtaggtggggtccccaaatgtctacggtcggtggtggtccctagctagcacgatacgaactcaactgttgtagcaatctggctcaacaacatccgccgcaaaacacgagagatgcgttgagccaagcaacggaattctccagctccaggtatattttggatcgacccaacatcaaccaaaggcgtactatcaaactacatctcacctgccgtacacgccctcgtcgttggtgggtgccgccgactcgatcgagtgcgccgtgtgcaatatcaggacccggtaggcgctgcggcgcatgcatgctgcggccgggtagatgatcccgagttccggctgaaaacttcccttcctatcctacccgcagcaaggactgcgtgcacatcttagcagcgggattggagtagcggtccgagtcacgctgctgcacgcgcgggcggtcgttggagtggccgactgcgagatcgatcggagcagctcgggacgggaacccggccgcgtccgtgcgtgactcc

SEQ ID NO: 13383 - DNA, 375 bp, Zea mays
gcgagtacctgagtattggccggcggaggcgcggagcttgaactacaggacgctttcgagtttcgagggcgctgcagaaggggaaccctgaaggcctgaactgagggcaggtttcgtgcggatgcgcattggggattccggcattcccgtgttcaggcagccccatctactcagactcaaagcgagttcctcttgatgggcctacgtgatccagtctagtaaaagaaagaaaaggaaatggcgaatttacggcccgagagcggtcccacccaaacacagttctggacacacgaaccatcgaacattctcaagattggtgacccagtgtcacccgaaaccctgcggcggcgaccggctgtccggtgaccggtggcc

SEQ ID NO: 13384 - DNA, 1500 bp, Zea mays
tttgttagacaagcatttgggctggttccactgtcctgttcagtttggatgcgacccgtagctttatggtgaagaaggaaacgttgttctacaacattagcagcgcatctctcatgcagggtgcaggctaaatgtcgccctcaaatttcgtgcaatctttgtttttgactttttgtgtgcgggttatgtacgcttatagctggtccaggcttagatacatttggttatttgcagttgttgttgagcatccattctcttcaaccatgatacttacatttccaatgttaaaccgactcttttaggtatctgctcatgtcatatttatggggtaaaaaaaatccagtacccagctgtcagtaatgcgcgggttgcacgggaggaacacgacagtggacaagagtgtgtcagaccagctacatgccagatgggttgcgacgttcgacaaggcccagctgtagcaatgggatggttatcgggccggcgtggatcaacttcttgaaagcattgcgtgaagcttaagtagatgagaaaggagttggaagggggcatcttgtaacagaattatattccaccgtactctactgaaaacttctctagctatctgttcttctctacgtctttccattgttcttccctgcctctaccaaattcttgtgttctagcctagccgattgctaacaccctggtgcagacgaggctatgagaaagtcctctccgctgtttctgttacggtagtagatgatccacaaggtctcaccttaagcaaaaaataataataataatggtctggtctctaaaagtctttctaatttactctttaaattatcatctttctaaatttcactatctaaattattatctatagagttatttctattaaaaaaatgcattccctaatagttttctatatcttatttaaattgtatggagctatttttattttccaatttttatgaatgaaaaagttagaatagaagattattatatttaaataaaaatttctaaacatttttggtaaagtttagaataaaagatgactatatttaggtagatattttcaaaagctgttggtgtgtaaatttttttactaaaatctctatttatagcgattagaaacaccagtctctcggattgctctgttctcaccaaactttctaaagctcaccatttgccctgcctacttgggtcgtacgcaaccctcgccgagagcagcccccgtaaaatcttcctctgcatcctattcgctattgccgggggggggggggcatcgccggtggcgttcgtgtgcttctcgctacggtgaaacctttattgccgttcctgccgcactttcctcattccttgagtaagcggacctctgcccccaatagtttttgtgattctcagtgcttggatttcagcgggctgattgcaaatttgtgcccctaggactttggccgttggacggtgtactctgcgggatccccaacctcctgctgagctcccgcacagagggcgggc

SEQ ID NO: 13385 - DNA, 225 bp, Zea mays
gtgccgtctatgtattccaccaagggcgccatctagtattcgcaggaccgaggatgcttcagataatagtacaaatggggttaaacagctgactagtgagtttgctcagaaaaatgcactggtaatagtttgagctcgcattctgaaactagattaattgagcgtactgacagtaactcagaagtctgcagtaatgcacaacttgtagtctaccagtggcccagc

SEQ ID NO: 13386 - DNA, 785 bp, Zea mays
tattttaactccgattgtttaaaccactttgtttaaacatttttattttgtacgagcaaagaagagaagaaaggctcaatcttgtacaatcttgtaaaacctctgattgatgaaggtattgccaccgagctgttgtaagttggggagaatcgatgcctatctgccaaaaccatggtggttggtgcttagttcatggcctgggctgtcacattgagggcactgacaattaggtctacaatgggttatggaacactgattttatatttgaaatttgtagtcttgacctctcgaggaaggctaagcatcacaactttttaggccaattttgctacttagaaggtgaatggagggactttccatctggatcttacatagtagcttctgatactcaaacggacgactacatacctggattttgttgcttcaagttgacccaggcttctttatttagagcttgcagtttgattcagttttgttctcttataatcctctgttacttgccttgtttaccagtcaggaaacttaacctgtttaggttcacattttgctgagatggacacaatatgctacttgttcgcttatgtgaacttgatctgcttactatgagcacattttttttctgttacaaaacgaaggaaaacatatgatgcataatttctttgcatatctttaatgtcattgacacctactctctttttacaggttctggctaaattattttaatgtctttattatcagagattccagtaatgtgccttgcctcttttatgtgattgtacaaatca

SEQ ID NO: 13387 - DNA, 316 bp, Zea mays
tgcagagacactgacatgatggccccacaccgcagtcagggtcggaacggcgcactcgcgaacggaacggggaccctccctctccctctcgctctcgctcgctcgtttgtttccttccttctttgccccggaggcgtcaccagagcattcgtccccttcgcctccgcctcgccgccaccacgcccccgccgccctatcccaccctcccccccactctctcctcgcatggcgacagccccttgccggtagccctagatccagacatccctcgcccacgcagcaacagccctcctccctcccacctgcatgcatgccc

SEQ ID NO: 13388 - DNA, 1500 bp, Zea mays
cagtctacacaagtaggtataattaattagtcaaatattcatggcctttaaattaataattaagaagcaaagaatattagtttagaaggtaacatagcatatcactatgtttcggggcaacaacatacaacatttttccatgtcttgaaaccgccttttaatcttttcattatcaattttttaagggtgtgtttggtttagctagctttttgaactagattcactaccaaaaatctgaaatctcaaccaaaagagtacaacaacataatagattccagaaaatgtacagatttatctatttcaatttagaatcacccgctaccctaaattttccagattctcgtaatccatgttataagctatcattctcttataaaatttatactggacaattatttcaagtaaacaaatttcagtttttctataatcatcagctcacaacagccttctacacctcacagttagataattagattcatattttcaataatctatagttaaaccaaacataccctaaatatctccttattatagcataccatcaagttaccaatagagagggctcaaaccccacccgcccctcctaaccaccgtctctcatagtgcacagagagagcagagaccgtttggctattactattaggctatctcttgccgttttatctatcttatcttctatttaaaattttaaatttaaatttataaataatacaatcagcagtataaaatatgtaaatagtattttgcaccaccacatgtctgttggccacatccttaatcagatagttgcgtagacctgcaatcccacgaagagcaagaaacgtcacgccggaaacattatcgttaagggctagtttgagaaacctatttttcaaaaatatttttatttttctaagaaaaaaattttattttctcttggaaatatgaatcctttaaaaaaatagagtttccaaattagaaaaaaacaaatccgtttatctatggcatctcgcacgttgtagcgcacatgcatgcacggcgcagcagcagcaattgtcaccgcagcggcaggactcccgacgccaagcgtggaaggcaaggtaataaggcggacacgcctcccccgcctcgctaccctccaaatccaccacccaacccgtgcgcaacaaacagccggcacgccacgcagcctctccttcacaggaaccaccggaaaaaaaaatcctataaaacgacgcgcccgtctcctcccccgccgtcgtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgattcaagcagcagcgcagg

SEQ ID NO: 13389 - DNA, 832 bp, Zea mays
gtaatgctctcccttgtattacatgtttcaacttttatgtctatttttaagcgattctgtttcttcatatttggtgagttatagctagaccatctagtccccttctatgttcaattcccataaaactactgatataagttggtgattccatgagtgagcttctcctttaatttttgttggttctaactttgcctcataggatatatgcggatgataagctatgtttttatccatttgcatcagtaccactgaaatatgccttgggtcttttttttaatttcatgccttgggtctttgacaggctttagcagggcaaatgagatagttggatttagtagaactattttaccgtttaatcatattatgaatctgaaacatatctgcatatggcatttccatctgtcatttgttcctttcaatacttagtatctgtgcaatttgcgtttagaagtgttcacaaggttaacatttcagaagtttattttttccaggacataaatttgggtttcctgattgtgctgttatctatgataaaggcatttgaccctactagttagcattgttttagttgacttgatgcttttatctatttgatttgatatatattactacaattcacatttggaagacatgtaagagaagtatatttagctgaaactgcactggagcatgacctttgttcttcagataattttttcttttcatattccttttccttgtttctgttaagctcaatgtacaacattaatttcactgcttgatccctttcagcgttcttcgaaagacttttcaagttgggatcaatatctacagccagagtgaggttgttgcc

SEQ ID NO: 13390 - DNA, 491 bp, Zea mays
cttcgtgaacgcctgccctgaacctgaaccacggagctttcaatcttcacgtcgaccggggcgtcccattcgttgagatcgctcggatttttgtatatatatttttccgggtcgaaactggcggagatccctcgctaatctttttgacccttgcgggcgcggggttggagttgggccaccaacggtgaacagggtcagagccttttccacgcgggaaccttcgcggcagcgtcgcccatcctcatccgcagcccacgaaggcacgaggtggggcagggacacgctgggcccacgaagctgggctgcggctgcgcacagcccgtataaacgagacccccaagtcccaactgccttgatggccaaggaaacaggcctgccagccagccgcctttcgaaaccgagcaccagggagcagacgcggtctctggaacccaggttccagcgagcaaaccatctaaccaggcgctgagaattctgtgcggaggaggcgg

SEQ ID NO: 13391 - DNA, 366 bp, Zea mays
ctgcagccctacatcaggtatgatgatctgcataaatctcttatcagcctgttgttctgttggcttggattggcttggcttagcttttctacactattttgtatgtatgtttcccttgtgtccagggacttgcatgttccaggtgcatcgtcggaaggattgcttatcaagtataccagaagaagccaaccaaatgctgaagctgaacctatttttactgcaagataataatcaaagtacggccatgtcttggcgacgtggtgcattgcatttgcatgctagatattgtcaatggaacccaggttttgaaaaaaaaaacatttgtgccttttgctgtaacttttgtttttggtgaagaaagctgaa

SEQ ID NO: 13392 - DNA, 545 bp, Zea mays
tgcagtaaaaccatagtatctgccaaaaccacatcgtgtttggttcctatgtatttgggcattggtgaccacagtctgtttgcgacgcatggtttcactgtttatttgaaaaacagaggtgcataccaaagtttctaaaaccacaaaagtactatagcatactaagttttgataataccataattttgagtactaagttttggataaagttatcaaacaccttgaagccaaaaatactatggttttaaaaaatgttgccatgtcaaataggcttttaaagactgatttggtgaccagaaaattagagaagaatgatttgttaaccagagaattagagaggatctataaaaaaaatcttttactattgaaagtttgttatagcccacaacgaaccgcctataaaacccaggccgcccgcgccaagtcgctgccttctctagtgcaatcgcggagctacctcagctgccgtgtcctgcacagccgccgcttccgcaccggttccgacggagcaaaggcgaaagcgaagcagcaagcaatcaagatcg

SEQ ID NO: 13393 - DNA, 144 bp, Zea mays
cgttagtttgcttgcctgttatatcccagttcttcagatctagcttgggtcgattgctttctttctttatccgttgctgatgctgttgtgtggttgcgatacttcttttatgcagcgtcgaccctttctctaagaaggattggt

SEQ ID NO: 13394 - DNA, 285 bp, Zea mays
ttaggaaaaaaaatagagcttttcgcctcttaaaaatccttttaaccatcgaaggttagtgacttatttcgagagaggagtacgttttaagccggtgctccatgtgtcccgtcccgtgtcccgtcccgtctacgttttaagctgcgagcgagatctgctttcacagcgtggctgaccagcagatccgtcgttgccggaacccacgctcgccggctgcgaatgcatctgtagcctgctcttcgtccacacggacaattggacgagctagactctgcgtcgccggcg

SEQ ID NO: 13395 - DNA, 1500 bp, Zea mays
ctcaacaagtgtgtttgacttagagatagcaaattgagtttgatttgcaaaaacaaaccaagtggtggcaaagaatgatccatatatgccaaatttgattcaaaacaaattcgtgttctcatttgaattgatgttgcacttctttagttgctttatgttgtgttggcataaatcaccaaaaagggggagattgaaagggaaatgtgcccttgggccatttctaagtattttgatgattgagtgccaacacaagtgcttaagtgtaaatctatgccaattgatggacaaggtgcaaatcaatacaaaggtatgattctaaacttagtacaatggtttttgtgtactaacatgtttgtctaagtgttagaatcagagaaaatgcaattgaaaaagagtggctcgaagcagccaagagtctgctctgtctgggtgcaccagactgtccggtggtgcaccggacagtgtccggtgcgccaggctggctcaagcgaacttgctgctctcgggaagtgattaacggcgtacggctaaaaatcaccggactgaccggtgtgcaccggactgtccggtgagccaacggtcgaccgggccaacggtcggccgcgcgatccgcgcgagacacgtggccgagccaacagccgggagggggcaccggactgtccggtgtgcaccggacagtgtccggtgcaccaacggctcccaagtgccaacggtcggcttcgccaaataaggaaggagatccgcaccggacagtgtccggtggtgcaccagactgtccggtgcgccaggcgacagaaggcaagaattgccttcctggaatgctctcaacggctcctagctgccttggggctacaaaagggacccctaggcgcatggaggagtacatcaagcattctccaagcattcctaagcaccaagacctcgattccgcgcatttgattctttgtgatagcaattagagctctatttgagttgtgaactcgtcgagttgtgttgtgagctcttgttgcgatttgtgtgcgtgttgtcaatctgatttcgtgtcttgtgtgtgttgttcatcccttccttactccgtgcttctttgtgaacatcaaagtgtaagggcgagaggctccaagttgtggagattcctcgcaaacgagatatagtaaagcaaagcaaaacaccgtgggtattcaagtgggtctttggaccgcttgagaggggttgattgcaaccctcatccgttgggatgccacaacgtggagtaggcaagtgttgaacttggccgaaccacgggataaaccattgtgtctatctgtgattgatcttcttgtggttatcgtgtcttgcaaagactcctatctagccacttggctttattgtgctaactcctaaccaagtttttgtggcattaaagtttaagttttacaagatcacctattcaccctccctctaggtgctctcaattggtatcagagccgttctcttcaagaaagggactaatcgcccgaagag

SEQ ID NO: 13396 - DNA, 511 bp, Zea mays
gggggaacaccgcaccgcaaacaaaaatctcctctttgaggggtccacatgccagccaggcagccagccagccagcctgccgtacctactacccagcagcagcagcacacgctgctattttttgccgttcctgctagcatgtgtgtcagtgtgtgtgtgtgtgttctccaaccatctccgaggatctcgtcagtcgtcacgaaatctccatggctggagcacgcgagagaggccaggatacaccccaggtccccagccgcgcccgcgctatataaagctcccgccccccattcccttccccctcctcccccagccccaggtagtagcttagctagcgtgataatcaccgcgctaaactgatcatatatacacagcaattggcgtgtgacaggacacaggaggagggggcaggctggtaatatatagcaaaagtacaagcgttcctccagtggcgtccagcgttatatagttcgctgtccggccggacgtccttcccccaggtacaaagagg

SEQ ID NO: 13397 - DNA, 1148 bp, Zea mays
ttttgaacgaatatagcttttgagctgcaggcaatgagctgtgagctgtgaagcattccaaaagcacaaaacagtgtcgaagtgacaaaacaaagtataccaacaaaaaatgttagtattagcaaaaaccaacaagccgtacgcgcgctgaagcacagcgtaagatattcaaaatctagcacttcggtggtagatagcgcgatatccattcaaaatttggaagttttttaccgagcaaatttgaaattcggaggtgccaaatgacgagcgctggtccattttctgtcagtgtcagtcctgagtcctgacacgggccggcccacatgcaatgcaatccacgcgaacccggccgaatgaacgaaccgaagccattgccctgtccgcacgtgatgacgtagcgtcggggctggccgtccccgtccgcccgcgagtgggaggccaccgtttcctctcgcaccgggtcgcgtggagggagggcatggggccatggttcccagcgcggggcgccgagcgcgctcctccgctcgcgcagcgccagcgccacccccgcgccgggctttatataccaccctctcccaaccctacagaatcatcgcctccaccgctctctcttcctctgctcttctctgcctgcctgagctcaccgcacctcgcctcctcaccgcgtttcctccgttaatccggtaaccgtctctcaccatctctgcagtcaccctagagtccctctctgcctgcccctgccagcgcgggggcgcggtgtggctctcccagatccgcctggcattgctcgctcggggtcgtgccaagccgatccgatctcgcgcttgcgcgctcctgccgcggatccggctggatctcgctggaattggggcgcgcgtttatttgaaatgcagcagatccgcgtgcttgcgcgcgtgatctggccgtcgtcgcgggcctttcgttaacgaaatggccccgatctgtggtttggtggtcaatgccatgtttttttttattattactgtcttatgctgggagaaaaatagaaacagagaatagcttcaattgatgccttttagaacggattctatagagcaactcatggatacttttctgcttgttttaacaaaatgtggccatcgggcgagctctggtgtaggtagaaa

SEQ ID NO: 13398 - DNA, 167 bp, Zea mays
cgtctccgcagccatcgacctcactcactagctagcgctagcttccagcagcagcagccttgtcgtgcaacagcagcaccaggaccaggctaccaccagttagctgctgcctgctggggacctggggtacggttgttgttgttccgtgactctcgtcgcacaacaca

SEQ ID NO: 13399 - DNA, 446 bp, Zea mays
acctactatactacagggactattttagaaatgtgaaatggaaatgcagaaacattaaggctttaacaatcaattctagagcatctgactttggcttctcaatgttacattacattaaatataaagatggcccgtgcatatctacgcttttggattcttctgccgcgaggcatatccatcctgctttggaacgctgctactgcagtagaatccattcctcggacgccgaatccgcctcccgccagccctccaaaaccaccggcgccctgcgcaggcagcagcccactgtcctgcggcctccgcttataaaaccgtccacacgccctccccgtctccaacaacgtgggcgcggcggccgggttcgttcgtatagggcaggaaactcggcaggaagcatgctcccgatcagtggatctgtctccgccaccggaggggcgaaggcgcgg

SEQ ID NO: 13400 - DNA, 1132 bp, Zea mays
gccgtacattttccttcgtttctcacagtaacaaccaacagagaaaaagctcccgatagtgcgtgcacaggtaaccaccaaccctgcagttttaacaccaggcctggttattaagcttcacttagggctagtttggaaactcaaatcccttccggtattggaggtgattgaggggagaatgcaataatttcttcctcaatctcctctaattctggaggggatttgagtttccaaactagctctgataaaagagagagagagggacagacagttgatagagacctcttgacaatcccaacaaccacgtgttgtcttttttgtaccagcgtgtaatttgcctccctgccttgtaccctcccctatacgttcatctgtcgtgtagacgtcggtgtacatatctattttggcgccctagttacaaggtagggaggctagttactgcatctgttactcgctccaaaggttgtgtgtgtacagactgaggacatttctcatctcatggcagcgccgactttccccccttattgcgagcataagatcacattcttttatctcagattagattgaggctagagactattccagccaatcaatgctaacgaaaataaatgtatcattacacctggaaccatttcatagtaaacgaaatgatactatctctagcagcttacctatttctatccctatatattaaaactttactcagtattgcagtctacggcacaaaacattaacaaacgcccatcttagatatactgtgtataaacacatagcaaaactatctggaaaaatggaggaatagcatagatcaaacacgtggttacaactcgtcctgagcatcgacatcatgctgataatacccccactttgattcagtcaaaaataaattccaacccaatgatatcctggaaccaccctcagatttccagtcctccgtgttgactccttgctctactactactagtagcacagtagtgttaagaagctacgtcacggatccgtcttgtccaccactgcggccgcactagtctacaactatcagcggtgcctgcaggccaccgccggcgcccgcgcgcggaggaagtgcatgcagccaggagagagctagcatagcagctaggagaaactaacc

SEQ ID NO: 13401 - DNA, 1500 bp, Zea mays
tcttccacgcgcatggattttcggaaaagctactacgcatttcgatcagcatccacggagtttattatgtatggatgtatgtgttccctcagcacattgacatcttgtatatatgcccaaaaatgaatgtgaaccatgtggagtgtttctgaaaaaaaaggagctgaaccctggttggttgttgtagcagagactacatgtgcatctcttgtgtttgacatgcaatgagtgtgagcctagtgtgtgccgtggcgtatcgtgtctggccggtcctgttcgattgcttaagaaaccacgaaaaaagaaagctttacaggcagggcaggtagtagcctgctaatttttaagggcttgcttggttaccgggcggcaggggccgtggattttatagaacgcatgggacggagtttgaaagcatttgtaattctgaactgggactggatgaatccgaaagcgattgacgctttgctatggcgaggaaagatgggaggccggcgctgccacgcgaactctgaaaggagcccgacggatgatgatagggtatcgcgggagtcgaggatcggtggtccattcttgtttcttctgttgactttgtaccgccatgccatgccatgcggcccgtctcgatctgatcggggtagcctagcccctcgaaaatagcggattcagttcagaaactgatacgcagctttcatctctcttcaggaagaaggaaatagaagaaaagaaaaaaaaactgctgctgccttctcttgttcgcaggccagaggatatgagctgtatcaatccacggttcttgttctatacgtgagctgagacagcatcaattttggagtcgagatataggccacatcatccatgtcgtcgatgcgacctcagactacagctttggtagctagctacctcgcactaggacggacaaagatgcagtagcgatcatgtccaaaacaattagctggctctttttgtcttgtattccagggacctagcgaatgtggtttactaggacggacaaagatgcagtagcgaatcatgtgcaaaattccaaactgaagaatccgattgctgtgcctttgaggtaatcagcagcgaatgtccgtgaaccttgattgatgcatgggggtggggataaagctaggctaggcaaatttattttttattttttccccacttgcctaaacaatatcctatagtattggtcgcgtctctctctctcctccaaatgtcacgatgtaggttgttcatctccgtcccccaaatggcgccgcgacgggaaaactatataaacaaacaaatcatcaggatccatctcctccctatatatacgccactctccgtcttcgcctttggtctccatcactgattctgattctgattccagccaccctgaccggcgaagcgcggctgacatttcccccccaccataccgccaccacctgagaagagatcgatccaatcagattaaccaattagcagggagggaggagaggggcaaaggca

SEQ ID NO: 13402 - DNA, 350 bp, Zea mays
tgcatgcctgcagcaatcttctgctaacgccaccacgcgcacacggcggccatgccagacacattccttggggtgaaagggcaatcttgccacaccccttcattcccagagtaccttaacactggcatctcgtcccgaccagcaggaccacagcacaggccaccggttataaaacctttaccccatccagcaaggccattggaagccaccagcaagagaccaacagcaagggtgcgaagaaagggtggccccctagctagcctagctagagagtcatcataatactcagagagaagcacgagcacagctgcactagctagctactgcaaagaagcaagctctcgatcaca

SEQ ID NO: 13403 - DNA, 1500 bp, Zea mays
ctagctaggcgtgtatgcagatcgatcgatgagcagcccaggtgacggggggcacagagatgagtgagtggtttgatgggaagagggtcagtgaatgagtgagtgattgtgcaacttttgctttcactgtagggtgagagtttgatccctccctggtgtgtgcgatgcatgctcggccggtgttccctccaccctttgcccacttcttcttttttttttttgcccttttctccaattccattggtcttctctgattacagggcagacaggcaggcaggcggaaccagagctccgatccagacgagattattagaagcagggatcgaaaagtataaagcagtagtgataaaggctaataatgtttctttttttattggtttgctgatggcttaaattaattcttctgctaattaacctagctacatgtgccgcgtgactggctgactggctgactgacacccacgtactgcatgcagaaacatacaaccaatctgagcattagcttgtggtgaaaggctagcagctggctcactgcaaacagaaagtgaactagtccctgctgtctagctagctagcttagaggtgtgtaaaacataggcaaattccttttcagttgcacctcagttttgcacacagtcgaaggccagccacacacacgcacacacacaagcatgagctcaactactttggccacacaaagatagtaggaatactccctatgtcgagctcatcagttactaagaaaactaaaggttggttggtgctagcttgcttttgccaatgcctcaatggtctctgtgcatgtatatatatatgttaggcctttttttttctctttactacgtacattttcaacgcctggtggtaataagccaagtaaacactccaatgacacagctgctcaggttgtaccactccacgccacatgtcgtcattgcatgcatgctagctgccattgataaaaagatagatgcagaaactaaaggggggaaaagagaaggaggggtatagcacgtctggctggatggatgggcgtggctttttggacctgcagagggagtgcactcgattgcagcatctctttacacgtatgttgcccccgccttgccctggctgcatcaactgcgcctgcagagggcaacaccaaaccgtctgcaaactgcaaagcactgctgctgcctccccctgacgccttttttttttcccgatcctctcctgttttaatacaataataataatctgattgccctccggcctcctctcctctctcagataatcacgctagcttggacagcactagaagccctgagctagctgagaccacagaaccacatgggtctactatatatagaagctaggaagtagagaggggatcagtagctagctaaagcttagcccggcggccggccagaactgcaagagagaagaccaagaaacagagagagacaagcgcaggggacagcagcgggtagctagctagctagcgatcgacgacagacg

SEQ ID NO: 13404 - DNA, 641 bp, Zea mays
tggaggtagttctctttacaggattatttccactgatagttggtgtaacaaaaccatcagtggaaattagattatcattagcagttttgttacaccaactgtaagtgaaaataggttccactagcggttctttaagctgaccctgcctattttttctactaatatttgataacctaaaccggtagtgaaaatttgaatatgttagaataccaatatattaattaatttgatattatataagtatatataagcgttttgcatgtaattttttttatccatgtgcgtttagcatctgcactttcactagtttactaataaaatattgaaaatattaaaggtaaagacttttagcagtaggtctttttattaaagttgttatcgggcagctccattataaaacacgttaaatgtaacgcaaaatgatactgcgctgcataaaaaactcaaattcaaatataaaaatctgacatcacagtcttgaaagtaaaaatacacacacatcacagcgcatttctggaaaagccaaacttaaagccgggggcacaagcgaaagcgaaagcgcatagtgcccgtgctgcctgtcccttaccgcaacggtagcattcgaattctctccccaaatcgccaccctggggcaccca

SEQ ID NO: 13405 - DNA, 415 bp, Zea mays
aaccgtttacaccatgccaccatgttaatttttacattccttgaggtctaaagtctagaatagttaacaatttcctacactggagcttgcattacaaatttgaaattgttgataggatattccctagatttgcaaaaggttagtttgcatggacattggaggagttttattttggaagttgtttccttctttagccagagttcttccttggttccagttgtgtttacatggcgaaacattactccctctgtttcggtatggagtagaaatattgcaataattgtacccttcattccataaatggacaaacatggtagaacggtttctcccaaggcctacacaatagtgaaacggagtgactagtatctttaagtttttgtataatgtcaatttgtttattttttttatttgcctt

SEQ ID NO: 13406 - DNA, 64 bp, Zea mays
aattatcagctgggaactggcaacgtccacatacaaaaactaccatgcaaagtagaagctttgc

SEQ ID NO: 13407 - DNA, 737 bp, Zea mays
tttggccggagggcgcttgggatggccggtccacgacgaggtggcgggcgcccgtgacgaggaagatcgccggtgaggctgccgggcgcaataggagaagggggtgggtgcgttgtgctcgcgaggacatggtgaagctcaagagctacaataattggactagaattcaacagagacgggagggcaggactcaccgtagcggatgaaggcgcggcggcgctgtaacaccccgaattttgggagttgaattttttcttttctccactcgccaaattcgggcgttaccctttcctttttcccttttcccctcgctaagccttgatcttttccaaagttatagcgggattcggcttgagatctcgtgtaaagcaaaaccctaaaatactttattttgtttgttgcaccatgccgaaccatgcatttattttggttaattgaaattgtgaaggcattcatctagaaaatggggtttagaaaaataagaaacctttttatttttctcttcccccctctcctcccttttggcccagccgcccccctcgcgggcggcccagctggccagccagcccagccagcctctttccccccctttttttccctcccccgctgtgggccttgcgggtggcccagctggccttgcggcccagccgccccaatggccccccacgtcccccgctaggcgactttcaattggtatcagagcccggtgcttcattagagcctaaccgctcgaagtg

SEQ ID NO: 13408 - DNA, 1500 bp, Zea mays
gagggcgtgggtgggttacgcggtccctttctttccgatcaggtccgcgcgcgctgccaatgcgatccgatcctgtggacgtctaggctagctcccacggattcccacgcccgcccgcgcgcgctgtcggtggcgtggcgtcccgggggccggggccttggcctttgcacttcacggggactctggatgcgaccaaagactggcaggtggggccccgtacgcgacaccgaatccaagagcggcatcgagcacttgggagttgggatgctaacccatgggctccaacgacgtacccggccgccggagtagtaatgattgaatggataatccagctgctgtagtttgcaagccatgattcaaaaaaaaaaaaaacgcatagatgagcactgcagatcgatgacgaggatgaatccatcatatatacgctcacggctcaccaggaaccgacacttgccgccccgccgtggcagccgcctgcacaccccaaccgacgtgaagggtgcagcacgcacgcacgcacggacacgctgaccgacgcagtggtccggtgtgcacacgaagcaagcaagcagctcgtcccatccgcagggcaaaagaaaagtaaaaagaaaaaagaaagcctgaagcggaaccgggcagtaggagaagcggggacctggatcgggttcggggagggaacgggcggacggacggacggctggggttccggctccggcagtcctgctcggagcttgcttggaggcgaaggccggcaacgagagcgaggagacgagacgagaccgaccccggcgtcccgagcaaggcttgcaggtcgaggccaccaaccacggccggggccggccacgcgcgcacctgtcgcaaccacccacctcacccaacgcgcgcgtcgaccgggagggccaggggacgccgcaccggcacggcggcaccccgcgtcgtcgatctgctctgctccttctcacggcgccacgccgccaccggacccggttggacggcaatacaacgccatcagtgtcagtgatcactgatcagtcagtccatcggagttcttttcagcgtccagttgtacagtgcgggcgccgcagtacagtacagctacagcaccccacacccggtccattgcattgcatttcatcgcgaggaggcgccccgaactgtggatggctagcttgcttcgctagctagcttccccagtataaatattctggtgcgggcagctccggtctgccccttagttgtatcctctcctcctccttggacctcccatcttccttcctcttcgttcgtttctccaaccgaagcttaccggcattcgctcctggttttccggccaagaaccgatttttttccggttccggcgtagcagcaggcagctagcttgccaccagctgattcattgcctctactagtgtttttcctgagctcggtggggtgatcggtcgatcggccgccgctcgagacacgtacgtacgtacgtacccgatcgagggtcgctccaag

SEQ ID NO: 13409 - DNA, 1500 bp, Zea mays
gtctcgtctcgtctcctcgctctcgttgccggccttcgcctccaagcaagctccgagcaggactgccggagccggaaccccagccgtccgtccgtccgcccgttccctccccgaacccgatccaggtccccgcttctcctactgcccggttccgcttcaggctttcttttttctttttacttttcttttgccctgcggatgggacgagctgcttgcttgcttcgtgtgcacaccggaccactgcgtcggtcagcgtgtccgtgcgtgcgtgcgtgctgcacccttcacgtcggttggggtgtgcaggcggctgccacggcggggcggcaagtgtcggttcctggtgagccgtgagcgtatatatgatggattcatcctcgtcatcgatctgcagtgctcatctatgcgttttttttttttttgaatcatggcttgcaaactacagcagctggattatccattcaatcattactactccggcggccgggtacgtcgttggagcccatgggttagcatcccaactcccaagtgctcgatgccgctcttggattcggtgtcgcgtacggggccccacctgccagtctttggtcgcatccagagtccccgtgaagtgcaaaggccaaggccccggcccccgggacgccacgccaccgacagcgcgcgcgggcgggcgtgggaatccgtgggagctagcctagacgtccacaggatcggatcgcattggcagcgcgcgcggacctgatcggaaagaaagggaccgcgtaacccacccacgccctctgaccccgaccccgaccccgaccccgccggcgaggtatgtggtcgcggtcctcacctcagccgcagcacggcgacaccgcacccaccggccgttctccgatccccggcgctgcgctgaacagaaggcggtgggtgtcagctgttcctgacgcccgagtcggacgagaccgtaccgacggcggctgtttcggtcgctctcgtcgaccgtcggcgtcgcgtgcggccaaagcaggccacgcacgcacgcacgcacacggacaaaacaaccaacttgtcctcctctcgtctccgcgcaagggaagagaagggaagggaatgggactgcaagtgcagcccccgttcatgctacggccagcctgcagctacagcctacatttcccttgcctcagctgtctcgtactgacctcactgctacgcgacgcacataaagcaagcaagcaacaaaattttagttcagctgatttcagctgcaagtgtttttccgttagattttgtttggtgcctgtgagcgtctgctccgagcaacaaaatctgggagattctagaggaagaaggagatcagatagggaggggaattgaagtagttgttcgatatatttctcagcctgaaatcgttacggtgcctgcctgttcatagtatttaagtatcaactatttacagggtggacgggctattatgccacctagtcctctcctagaaacttggcattgggattcctg

SEQ ID NO: 13410 - DNA, 771 bp, Zea mays
gttaaagctaatacctattaacacgatgaagcatgagcgattacaaatttataccatgttccaatttcacgagataaactttagcagcttttttagctacttttagccatttttaatctaaacaggagagctaatggtgctaattgaagctaaactttagcacttcaattcatatagctaaaattaagcaggaggctaaagtttatccagtgagattgaaacgaggccttaaattaattgaagcatgagcgattacaaaaaaaaaattgagtggggaatagaccatcatttagctctccctagattcacccctagccatggtcgaccacttttccatacgctatggttcagtaatcttcattttttactgtttattttattcactattttaaacatcactctttacagtgtaatttatgtttcatacatccatatacacgcaactatgatcttagcaagacaaatttggccagaggcagtctgtccattttagacgagaagagaaaacttcggcaaggcaaatttgttttttcttcgtccaaatttctggcccaccttcagtgcctgtcgtccggttaagccgcactggacccggaccccacaccggacagcgtgtcctgggccacctcgcagtgaaatacgcctcacaagccacgccagcgacgcgaagagggcagcagcaagcagccgttcccccaaaaaaggccagagctcagcagagccccgcaggccgcacccaccagaaaccccagccgatcgacggtggcggag

SEQ ID NO: 13411 - DNA, 1269 bp, Zea mays
aactctcttcccactccgatttcgttattatttatttctaatcctaacatcgggtgaagctcgttttcaaagtttataattttcaggtttcgtatattcaccccctctaggtgacttttagaaccgaatactggaatatcgggttatttgctcaggttattcgggttcggtcttcagtctcggttgcctagctctaatgagggcagaggttgtagataagcaaatgagtcatttgtcatagcctccctgaacagactcatgctgtcacgacaacctaaattacgataggtgcaaaagtgacaacatttgaatactctctaaagcttataattaggtgtgcaccatgatgacatataattaaatatatcgaaggtgaagaatcaatgagtcacgattactcatttcattcacgttcacaagtttggattgattagttatcctaaagataatatgacaggtttgttgctaggctttcctcatggtctccgtctctctctatatcacataagctagctccgagttgactccttaaaacgatgagctggacttctagcgcacctcacaaaaaagctaagttgagcctagtcagtcaggagtctaataagctcacaagccacaattattttatccagctctagttaaaccgtgtggttaaataggtaagatttagaaaaaaaactatagtattatttttaagaataatttaataaaaagttaaaaaattcgtaccatgcttgatcgtgtgtttgatttccataactaaactttagtttatgtcatattaaatatttaaatattaattataaatattgaatataattttaattatattcaataaattcgtcttttttagtttttacctatatagttagttttataactagactatatttaatatttataattattattcaaccattgtgacaggaatcaggcggaaaccaaataccccgaacgtccacagcgagcgagaggccgcaaactcccgagaccgtacgaaccagacgattcaccaatcaccatggcggcgccggcgcggcgcaggtcctgcatctcctccggtggagccggagcgcctccttccgctgctgcttcgcctcttctccgccctccgccgcccgctgcgaggccggtccaaggccatgctcaaggggatggactactgactactccgaacccgagataaggacatgatttaagacatgtgtgtgtttcaagtagttcgttgattgggtgcaggcgcaggggtttcggccaggccaggccttg

SEQ ID NO: 13412 - DNA, 294 bp, Zea mays
tcaaaagtgrccagcaagacaagtttgtcgtcagtcccttccacaattaagagcaactcaagtcgttcaacactgactcttccatcaatgagagattgaaatgagcttcctactcctcggacagaaggtgaaatcttgtcatcttctaatttgaaggcattcacgttcaatgatctaaaaaatgcaaccaagaacttccgaccggacagccttcttggggaaggagggtttgggcatgtctacaaaggttggattgatgagcacaygcttgctccttcaagacctgggagtggt

SEQ ID NO: 13413 - DNA, 381 bp, Zea mays
tccctgcaggggcagcagcaataagttcgcggtcgcctttctctcctctctgcccccatcgcaaaagagctagaagccagaacagcacagcaccacgagcgccgatatataaagaggctccgtcacccgtaccgaattaccaacccaaccagacctgtacggggctcaaaaccgcgtggaggatcgtggggtaccagcgaacagcaccagcgaggcctcggccgacagcgctggagctccctctacctagctgcccagcggaatctcttcttcatgtccggtggtataacaagccattgaggagagccggcggagcttcgatcaggcagggcggagcgagaaattgagctgagagagagggggattcatcatagttcaccc

SEQ ID NO: 13414 - DNA, 961 bp, Zea mays
ttgcaggtcgctaacttgatgttttggcaatgatctagatgattcaaatcaagagtaacaattaaatttagcaaaacaatctagaatcaaaaccaagtatgcaattaatgagcaaaggaggaacgagattgccacaacaatcttgcatgaacatcacctcaatcacaaaagtgttgtccaaaagcactagagggttttctctttaaaatttccaaaatcttaatagttaaactttgtaggtctaatgtatagttaaacctctttaaaactcgtttatatataaaaatgaaatcaatctagtatttatatggagagtcccaatttaggccgaccgacccctttctggctggccggcctgctccttcttcagcccaccgctcagctggcagcttggaccgcctagatggctgggttgagcggttgagccctggcctgctgcttgtgcttaggccgcacccgtgatcttgggctgcgcgcttgcgcatcccacgccactgggcggtgcccggctagcttccctgctggtgggcctccgcgggctgcgcgttcctcacctaggctgattccttctctggctccacctgggctgcaccctcttgcgggtggctgcttgctctggtgggccggcttccactaggcggctggaggtcttcctccttttttgtgtctttttcttctctcccctacatccaaaacaaaaatctgatgtgctacggtgatgcaggtcgtagcttcggagtacgcaagtgatggttcagttgatatcaacaaacaacctgctctcaagcacagaacgggtaactggagggcatgctaccccgtcttaggtaccagagaagagagcagcaactcatgcagccaagaagttgcttctgtttgtttttctctctcttctctagtactataataacccgttcacttgttcaacgcacgcacaccaggtgttggattcagtgaaggc

SEQ ID NO: 13415 - DNA, 510 bp, Zea mays
atgattttgataacttcattaaaggtggttattaacgaattaataatacgaaagcaagagttttctcgacaataaaaaacatctcatcggaccgttagagcatctccaagagagcccaaaaaataatctcccaatacaagggaataaggatctccctaaatctcttagttccattctatatatgggtctccaacagatcccaagattttctcaaaatttaaatccataaagtcccacaaatgtcgtacgtacctgtacctgccatctcaaccttcctgtgctgccatctcttcctgcgccgccaccaaacgtgcagacgtcctggcgtacagtggtggcgttgattttttccccaggcgctgctgattattccaggtcgacgccggaaagctcatgtgagaccacttgtattgattattgtttttgctgtcgattaaatcatgcggagccgaccagtccatttaatcagagtacatgtgattaggtttcatctggctcagccacagagcc

SEQ ID NO: 13416 - DNA, 486 bp, Zea mays
ttttagagaaccgttggagagaagtttttaggctaactacttaggagtcctttagaaaactactggagttgctctaaaagacttgtgatagctaaaagttgagagaatttataaaggctccgtttggatgtagacatgaagagccatagaattgaaattgatctaatatcaagtctacctctgtattgaaatagacctcaattctgtgcaaatcagagggtgaccctcggaattgacggtgtgtgctatgtgctgcaattccacctcgatattgacgtacaatttacaccgtcgaattccggtgccaaccaaacagcggtattcgtgtagataaatgccaattccgaattgcacgccgcaacagtgacatccaaaccgtgccattttttcgagcggcttgagccacaacagccccactctgtctgagtgtctgtgcctgcctgtgcaaagtagggtttccaccgggacacaggccgcctccatccc

SEQ ID NO: 13417 - DNA, 695 bp, Zea mays
tcaatcccctccattactctttatcccaaacgaaccctaagggtgtctttggcacggctggctctagcttaggctcattatgaagctccgccaaacaaatggttaaagaaatgactgctcgtcgagagctctctaagagctggagccgattttttgttgggagcaacagcaccaaaaacatgtcttctactggcttctcttatatttttctcatccatcatttgaaaaaagaaataagagaaactgttttatcaaataaattgtaaaccagctctgattcctctaaagaagtcaaagaatgaaagaagatagaaagggaactgtttgtttttagaggagccgaatgccctgtcataggaggcctaacagttttcttgcaaaagtagacaaattgcacccgctggtagaggcatccattctgcggcccatctaatgatggtatgaaggcatgaagcccagacaaatgggccagtgctagtactggcccacctgacctcttggacctgcaagcaaaccctaagccaccgatccgacggcggggatcgcccgatcaaaccacagacagaaccatacccgtcaccacctcctttacataaaaggctctccctcagcgcgccgtcctcctacgcggtacgcgcacacagccaaaccatcctcctctccgccgcccgccgcagcagcacccaccgggcaag

SEQ ID NO: 13418 - DNA, 1500 bp, Zea mays
aaattaacacaactcatcaattcacaattcatatacatgttcattagtttaacccacaactatattcgtatagaccaatttaacagatagatacagttcattaatcattagtttaactcatatgtcatagacactacgtatacatgtaacatattcattaattattacgtaaatgatatgtatatagtttcgttttgcgaaatatgatagtttatttagttcgcgagctggttcgttaacaaattgagttatactgaccacgaactgaaataaaatgttagctcagctctgaaaaaaatcaaatgatctgatccgagccatgtcaagccgaactgatcacgaaccgagcaagtcgacgaccacgggcattttgtctgccttagacatcacacagttttttccaacatttttccatcacgcgttgatgcatgctacacagctaggacggtgggttgcaaattcgtcttcacaaatcactcattttatggtcttgctgatgtttgtagccattcacgtgaatatctctggtgctagctgcagtatgcaccagtatgctcttacagatattgagtaggcaatatgtgtttcccatgctgagactcaaaatagtactcctatgttataaaataaaattcgttttractttctgatggatttatataaaacttggtttatgtrttctatatgcgtgtctatatttattgtcatctagttgaccatatacataaaaatcaagagccaaaacgaatactatttcaagacagagggagtatccgttttagctcttgttttttatgtctatatttaaatagatggtaatggatctatacacatagataaaacacataaatcaaatattatatgaatctattaattgtctaaaacgaatttaaattgatacagatgggagatggaggagtattagagaatgagtaatcaagggaagcatggtacccagaaataaaccttgaggaaaagaagatgtacgtcccaattctaatagtttaagaaccatattttgaacatgttgaggttttaccatcagttcctcgagttgtcaataaaacccttgctacaaatttcgagtcatcgagcacgacaattgatgagccccaaataatggtgagtcgcgcatacctgcacgcgacacgacggtacgagggcacgggcgcacctgctcgagtgcatgccgcatgcctctaccgcgagcgttccacgacgttccgcatgcatggctggcacctgtcggagcaagggaaaaccagggcatgtcgtggacgcaccccacgaaaaccaaacgcctccacgtagcctcgccggctcccttgcgtgtctccgcttttcgcgcctccctacctatataagggcgcaccaacgtactcgaccggatgcgcgcaggcggttctcacagcacggaggcactcatcagtcatcactagtacttcactagttagctagcaatattcctactcgctaagtagtggagaactggagatcgac

SEQ ID NO: 13419 - DNA, 765 bp, Zea mays
tgtttttgtctctatagattgcagctgcatcagaccaaacaactgactttaatctgaatcaaacagctagtgttgatacacccacaaaaacattaaaaaccactattatatctacaagagaagcacattaccctctaatttcttatagcttcgcttctgcacgagagagatgtacactttctgttaatttaggttatgatgtcacattgatctgttaaacatttctcactagctatccggtccgtgatggaagcattcggctgtaggtgcttgtgccacctcactgctcacgggcgtcacggctcacctgcacaactataataaacgtgtttgaggtcttcaatactgcgcaggattttctctgctctcttgtgtaagacatcagtctacatgtacaattcgttacacggttttaattcggtcaaaaccccttataatgactatacttcaaattttctaggatttgaaattcagtgttatagtttttatcgttgatcttgggttgatggtatatcattatggatgaaatctttctgggccgaactggcactgtaggcttaagtgggcttaatgcgtatgattgccttggcccgtgcctgaagtcacgatctacatccatccagcacaccataccctagttcttccttcccgaaccctcgcgccgccaccgccgccgtctagcattttcctacacccaatctgatctgaccaagccctctgaacaccaccgcccatcctcctcctcctccgccgccgccgcccaag

SEQ ID NO: 13420 - DNA, 1500 bp, Zea mays
tggcaggcttggagttatcataaattcctttgttcctcctaaagctgcarcgtaaaatcatgtaacaaccatcgtgatatccaactatgtgttaaatcgcggaagaacagaccttttctcgaagtcactaattacttactatagagagtaatgtataataatagttcgttaatttggaaggagtataatagtatatatatagggttgacaatggactataaattttgtactataagatttaaggatcgaatcgggttaggatcggattctatttttatttatttttgaactataatttatttacgacctcgatattttatgaagaattatttgaattacgatccattaccaccctaagtatatatcagcgggtacacatcatccaagagagtaatgctgtataacagtagtagttctttggaaggagtattccgcatcaatcatcactaaaacactctgaatttctggagttcatcaaccaagagagtaatgttgtatagtagtagtaattttttttgaagtcgtcgttagctcttcactctagcgcttgttagtgcttgcggtcgtgtttctctttttttgtgctgtttttttttttgtttttgttttggtctgctcttcaacgttttgtatctgaggttctagtcttctcgacttctctgtttcagtattacctttaattccaagcacgtgcttctcgtgcgcaactctggaggagagagagagacaactactttcattagtcaaagaaacattaaaaaaacacacacttacaggaaaacgccatgtggcgcatacatttccggcctaaaagcttgaaggacctatttctatatttttcaggtccagaatgagcctgtcttgctcaccttgggcagctctgtcctatgttcagatgtgcaatgtttgtttatgtaaaaagatctgccatgccacggaaacatgtttacatgaacatgacagcactgtctgtttaccagaattagacctcgtttggttccattagttttaagattaaagtttagtttaaggactaaattttagtccctatactgtttggttgtaggaactaaacagattttaaatacattaaatacaacacataaagaccaaatgccccttttttgtttgacaccagttttttagcaaaggacaattggagtaaaatattgccctttaatcctttttagcacccatacgagggactaaagactaaagctaattagtctctattttagttcttacatttggtaaaatagagactaaacgggactaaccagggcgttactactagcctgcacattgttttcgtgctgtgagcataggattctcaagtcctcgtgtaccatcgtgctcaaatgtgaaattaaacgtgcacctcaaataatcatagaatttagttaaccagaaaacaaaaacaaaaaaaaacccctcattatatagcacataccaccaggaagcgccccaccactcaaggtttgctgtgttgtgtctccagca

SEQ ID NO: 13421 - DNA, 1026 bp, Zea mays
ttaaatggttctatctccatacaactaatttcatcatataaaactcaatcctcttaaatactattagttgtatggagatgaaaccatgttaactcgatttcatcatataaaactcaatcctcttaaaactcaatcgagtatgtcatatcattaatttttttgtgacacactattagtatatccatgaaaccaccgttgtgaatagcggtacgccgctacgacagtgtaactgaatagctgataaagcacccatgggttacctaaacggctaaaccctagactagccactccaattccgacgtgtcgataacaaagagcaccaggagagtacgagtgggggtgccggcgtccggcgtccgtatgtaacaaactaacaacgacatcgatgattcatcaactatggttaaggttggatgttggatggctcggtcccaagccacctcagccacgaacggggcaaagcgcgaggctcgtgggcctatttgccaaaaaaccatgtggataaaaccttttgggctgctgggtttacttggcgtgttggcgtctctcatccactgactactcggcccgaccaattatggaccccacccgttcggcaacctacacagctacacgtcattgtattgtatcgatcattatccgtgcaaccagccaatgagccaaccacccattccaccaccctgcaattccagtccgatttggacattgtcttcgtctccttcatcccctgcccacctgttctgctctgccgccgccgccgctgccgctcccgctgccgcaggaaccctagaccacgctgagcaacccccggcctacacggcgtagctttgcaggaaatggaatacggcgccgtcctcgccgccgcgccgctcgtcgcacggccgaactggctcctcctctcgccgccgccactggcgccgtctattcaggtcgtgctgtactgttgttagctttgtgtttgcctgtttggtgcgggacacgtttctggtgtggaagcgtggaatctggtgaggtaattgaccggga

SEQ ID NO: 13422 - DNA, 459 bp, Zea mays
tgcatgcctgcagtccactccggctctcgatcgagtgcgttgcgacctgcgagcacgcttcctcggtcgttttttacgtggacaaggctactacgcatatgcgctgcgcgacccaaccgcgcccgaaaagcgagggcacgtttttggtcaactccacaggccacggcgcgcaaccagcacgaaagccacgcgaaacaccacccaccacccggtgtcccggtcggcgctgtcgcccgcccgtcgtccacgcccacacaagtttccacggcatgtggcctcggactcggactcctcggccgaaccccgctatttaaccaagcgccaaatcttttcctcttcctcgtcaaaaagcacaagcaaagcaaccagagccagccaccactactcgcctgctccgctcgcgcatcccatcccagcggcggcagacagagagcagggatcggcgggtccgccgtcgac

SEQ ID NO: 13423 - DNA, 459 bp, Zea mays
cgccgtcgcaacgcacggacacatacctagtaataatgtatgtttaaacttactaaagttactttagtagtgctattaggcgctaaaatttataacttcacttttagcacttctattttgacctccaaatactaaagtttatctaaaacatattgctaaacagactcttagtcaaacaggcctggcccggactccaaaatgtagataaggcccagtccatctaaagagtcgaacaggcctggcccggactccagaacaacgcatgacgtcgaagaaaatctcagggacaccctccatccaatcagaaccgaccttgacccaccgataataaatttacaaaaaagccccaaaacaaacaggctcttctcctctcgtcttcctctccccaacccgtcgagaccatccttcccttcttccctcctcgccagaggagagtctcgctagctagggtttccacca

SEQ ID NO: 13424 - DNA, 839 bp, Zea mays
gtttccgtttccggagttaccgttttcgattttgtttccgataaaaaatatgaaaacggtaatggttttagtgtttaccgaccatttccgaccgttttcgtccctatttaccggtggacgataaccacatatatccaaacgaagcctaatccgctttggctgggttgtggttgtgagtactatacaacactggttagctctagagatagtttagcttagcagcctgtcggcgtcacacgtcagccatggtactgtactagcaaccgccaaccgcactgccggtccgaactcaagacggctcgcgggactcaagcttttttcagacttgctatcaatgcaagtatgaatttgctgccgtagtatgcatgcgaatatgtggttggatagtgtttgtgcaggacaggtgtcaagcagaggcaatagctgcttcctgcagacgagacaaattaaataaaataatttagataagatcgccagcggcgctcaaaaagccgtagcatgcaacggaacggacggacgggtaggtacgctgacgcaatcgtcagtctccaactagatcgcgtccacttgattagtcctaatcctagtcgttaataaattgattacggataagcgcccgtgcgatccatcgccatcgtcccccggcaattcctctataaatagagctcccagcgcacgccgagactcgatctcctcccatttgttcagctatctccaaccaagttgaaaccatcttgttcaaatcgccccctcctctctctctctcgtcaagcacaagcttctgtgcgttcgtgttgcggccctgtctgctgattggctgtggatccagaggcgaaact

SEQ ID NO: 13425 - DNA, 126 bp, Zea mays
cgaaagaccaatcatttatattgaaattatcactgcttcaacctccgcacaaactctccctctcccagtctcagttccaaagcctaaccctgtgcatcggtgcatctgtgctcttaccgagcggca

SEQ ID NO: 13426 - DNA, 1025 bp, Zea mays
tggtgagccagcggagcaacggctccctgcgccaatggtcgactctgcaaagtgctacagtggtgaacagtgtcatgcagaagtcagagcagtgaagtcagaggggcaccggactgtctggtgccgcaagaggccaaagcctccaacggtcgaccagctccagaccctaacggttggctgacgtggcagcgcaccaaacagcacacaatatctatccagtggcgcaccggactgtccagtgccacaagaggacaaagcctccaacggtcgaccagctccagaccctaacagttggctgacgtggcggcacaccggacagcacacaatatctgtccgatggcgcaccggactgtccgatgcgcccatcgccagcagccttggccaacggctaccaagtggttgggggctataaatacccccaaccattggcatccaagtttttcagatatcacattcaatacaagagctctagtattcactccaagacacaaattcaaaagattaaatcctctccaagtctcaaatctatctcaaacacttagtgacttgtgtgagagagattttgtgttcatttgtgctcttgtcgcttggattgccttcttcctttctcatttcttttctcaagtgatttgtaatcgaagcaatagacacctaagtgtgtggtggtccttgcggggtctaagtgacccgggagattaaggaaaaggctcactcggtttaagtggccgtttgagagagagggaaagggttgaaatagacctggtctttgtgactttctcaatggggactaggttctttggaaccgaacctcggtaaaacaaatcaccgtgttcactcgccttgattcttgtttgatttgttttcccctctcttcggacttgaatttaagtctaacactaaccccggcttgtagtgtgtgtttaaagttataatttcaggtttcgcctattcaccctccccctctagatgactttcaattggtatcaaagtcagtgcttcattaagagcctaaccaactcgaagtg

SEQ ID NO: 13427 - DNA, 210 bp, Zea mays
cgaaagaccaatcatttatattgaaattatcactgcttcaacctccgcacaaactctccctctcccagtctcagttccaaagcctaaccctgtgcatcggtgcatctgtgctcttaccgagcggcaatggcgagctggtcgtcgctcccggcagaccttgtcaaccgcatcgacgacctcctgctggcaaccgacgacctcgactgctac

SEQ ID NO: 13428 - DNA, 1500 bp, Zea mays
tagaagtaaaaaatagatgataccgtcataaaaaaactaccacaaagtcgtcaactcgtcatcaacttttaaatcgaatgcaaacttaaataaaaaggacccctatgacctatcaatgtaaaacgactcctgcacctgtcccagtgcgcgcattgaatccatgattcgattcgcagcacgcagtacaattcagaagtacatcgagtaacacaagcttatgcttttttttcgatttgacctgagagagtccagtccagcagcagtaaatcatatttttcgcacaggccatctaatcctccgttgaaacccaacaaaaaaatcacgtgcgatcctcatcgatcccaacgaagcatttcccttttactttcgccaggaccaggagcactcccaatttcttttccacctcttctctttgtatttcgcccttttgcgatgtgtatgggagtactggtgtgggcccatcgccgatggctccctgtcctgcccctgcctccccaattgctcgctttccaccccttgcctctgcaacctccaccaaggaattctttgcccaatgcgctcatcgtccccgtcacacctctgcccacgcaccatcgccgatcctattgcccactacaatttccccatttctctcacgtaagtaggccacaccatcgcgtcatctctgctccgcctccttcccgccggcttcccgccgtcctttcgctgccgctgccattaccgccactgccgcaccggctggccgcgctaaaacagcagccgcgcccgcgctacgctgaccggcgacggcggccggcaagactgcccgttcgtccggtcccttcactccaccttcgcgcaacggcacaaggcggcaagggaccggacggggccggcctcgtgctttttgtgcgtggttggagtggttgagcgagccgatggcgacgatcccgggcggcgtggcgccatgacggcagccatttcaatacgcgccccccagcagctgaaacctgacaagctaaccagattttaggtggttacccgtgccgtgtcgcctgcctcgcacacccctcgcccttcgcctcttttccaccctggacccaggatatagttcccgctctcgtcgcttgcgcttgtatcttcctcgtctcaggcctccccgccgcgcctttcggttcgggttcagcgaattcagccacgaagcgagcgggcggccggagggttcctggtaacggaactcgctcgctttccagtttccaggtcaggccaggcgacgaccgccgcctcggcagttttctattccagcgtcgcggttccgggtcagaaattggttgcaggctcgcagccagccagtagcccggcgagatcgtcttgtgacagcggcaagtccacggcggttagcaggttgagcgaaccagtggcctggctacttaccagcttgccgtgccatgtgcaactgcggttcttcctgctgatctcgggagctgcaagcccggctctcggccaccgttcgtgggcgtc

SEQ ID NO: 13429 - DNA, 437 bp, Zea mays
ctcatctcgtgctggctgaagagttttactgtattattttaaaggttgacgacgacgacgactgggtgttgcactccaaccgctggaggagcttagacgagcgagctaaccgtagaacggggcgcggtgggggatgccttctcctggacggccggcaccggttgatcggcggtgtccccggcgtgatgagcccgttgttggacctgctgccctcgtcgtcggaccaccggatgccgcccggccgctcgaagcggccgaggtcgaacccggccatcctccgtggcttcttggggctgaacgagtcgtcggagccggagccgccgtcgtcgccggatccctgcccgcgtttcggccgtatggcgaacgtcaggctcgggtcccactgcatccctcccagctggaaattaaaccgcgcacgtcgatcgatgagctagggg

SEQ ID NO: 13430 - DNA, 638 bp, Zea mays
tggccccgtaaccattatgtactattacttccctacaattttttcacagctgaagcaaccaaaatgtttatcacctaatcttccactacacactcttcattcccacacccttcgcttctcactccaggaaacccacatgtttccagcagtacacgagtgggtgcgcgagtgctctttttcctccccttcctttcgcggcctttgcactccaccggaccaggacacggtcaccacttgaaccgcttccagatctggagccggcatgccactgtgacgcagacacggccgagagggacacccaacccagcggcggcaccaaccgttgcttcacaggcaccaatcataagctggctgggctccgagatgcaccactagcgacacatcacccacccagtgagatcgccaacccaacgcaaacgcatcgaggaatagaagaaggcgaggataaaaagaaaactttcgcaccaccaactcacactgaccgcaacttcccaacaatctcggtccctccctccctcctccctaaactccccagcaacccgcggccgagccccgtagtccgtgcaccagttgtctcgcgtcgtcgtcgtcgccggggctgcagcctgcaggcagcgacctagctaggaacgggtgac

SEQ ID NO: 13431 - DNA, 115 bp, Zea mays
tgtaagcattgtttctaaagtgctatgttttatatggccttacaagtaactctttgtttttaatgatacttaaaaagatgtacaattcatttcatggtaatatagaatcatcgcc

SEQ ID NO: 13432 - DNA, 1500 bp, Zea mays
tggggacaatatatgattctagagagctgtcaggaataaataccgccggtccagggattatacggggtgttacaatacactagaggaattggtgcggcgatgtatttaagaggtgtttgaatacattaaagctaatagatagtgggctaaacaattgctattaaaattaagcttgctaacaaataactagctaactattagctaatttgctaaaagtagctaatacattaattagtagctagactgtttggatgtatttagttaattttagtaactaactattagctctactgcgttcaaacatcccttagtattaaattaatttcagctatatgaccttacatgcagttggataagattcagccgtggtttatatgaataatcatctcgtaactatagaatgtgtaattctagctttgtcttctccaaagagaattacactggccccatgaaccttgtgtcgtgctgcccttgaatcaggacctgaaaccgtggaatgtcggttcaccaaaaaaatttgggaggaagtttctatttggtagctatcgaggatctgaaactgtccagctgagagcgatctcactcgatgtgcctttggtgggagaaattggctatgctgtcaagatgcaacaggaagggcactctattgattcttgtaatctgagaaatatgacgagaaagaaatgcaataattttttattgcaggttctcaagcagtcagtaaattatagctaaattcataagtgtgaggcgaatgtctggggaatggcggaggctaggcatctagcaaccgccatagctgtcatttagtaggtctatttttttctatttgttgggcttctggcgattgctccaatctctgtagtgttttaaagtttcttgttattcttcttatcaataaaatttggagatctcatcccttttcgtttaaaaaaaagagaaccactcatagccaactcaaaactgattcaggtagggattaaaagagaatcacttctccatttaggtggagctgagagctaaaaaatacctacttcattttgctccctgtaatatttaggtgaaatcaagagaatcacttctcatcaactcctaaccctccatcagagaaaaggagcagagttgaagaatcagatagctgtctcaaatagctgaaatgtgtaaaaaaatgcggatacagatctggattataactacacaaattaaggagtatcctcgcaaaagaaaaaaaagaaatgaggagaagagacaaccgatcggattccgaatttccgatccgagagaatcggccaggccactcgcaccgcgaccactcgtcattagtcgcgctcctcccgcggcgaaccccacgtggaggccgcgcgcagctatataatggactatccttggatccccgcatatcgttgagcgagttccgagggtgaggcggcgattgctgcgttccgtccgttcgtttttgtgtggggcagaagccaactaagaccgcgaggagatcggagg

SEQ ID NO: 13433 - DNA, 472 bp, Zea mays
acgcgcgcacgagctggattgtacagttttttgttttggtcgggaatgggacgaaagatatgaaatgatgatgagcggagccggagagccgaatcaaatctattaatcggtggcgctggaagggtgctgccgtcgattcctctaccggtggcactggaacacaagtaaccggcagttgccgaccattaccaagatctctaaagggcttagattaattagataatccagcataagcacaaaacgttaatctcaaatctattagcagatataatattgtttgtgtgacattgtactgttttgtttcttaaacaaacgtcattctacaaattttgcatctgtccctgtagggcgcccgtaagggcgccgcctgttctagtatgactaatggtcgatcccgtagtaaaaagctgtctccaatcccaggctacctgaacctacgaagagccgactcaaccgctagtacagtccacac

SEQ ID NO: 13434 - DNA, 812 bp, Zea mays
ttgattgttgtttggttatctgcagccactcggatgttcacattggcaataaaaccatcaaaggaaatgacatcgcggatgtataaatacccacgaccctcacccctgtaaacagcagattggttcaatacagtttagcttgtggttgccacattggtgatgttgtttctgtttcttcagtagttgtggcacaaggatactttactttgtagtctgcaaggaagtctctgtttctgttttgccacttaaaaagctgtaacaatgtggatttaactgtcagaatgtcatgacaatattggttaaaaatgtaatggtagacaggccagcagccttggcaaatcgcacgtttggggtacaggacttgggcttttgtttctggctgccgtgcgtatggccgcgtgggcaggcagcaggacggacctgagcttcccagcctctagtaaaatgttctctcaatgccaatggttgaacacagaccagagactgcaacgctagccattaagcatgtgcctgtctctgtctctttatttgagaattagtcatggctcattagtcaatgcaactgactccgtcagcctcctagcaatttcaggcgtggtgcctgcctgcctgttgaatataaatataaatcagttgcgtctctagcttgtgctgcggtgctgcctagtcttgccttctaccaagggtgtgccacacatcaaacaccattgatagatagatactgatgactgcttccttggaacaatctcctatttaaaagctgtgtgcataccaggcactcaggcagcacaaaggtcgacgagttaggaagg

SEQ ID NO: 13435 - DNA, 569 bp, Zea mays
atccttttaccttttgccttatccgcatgtactgtgggctactaagactcattttggtgtttgaacatgcatgaagctaaaacccatcaaaatcggttcagtattggttgttggtaaagattttagcgaggttgatgacaatatatatattgttcattttcatgtaatcgttgtgaattaatatttcattgaatgatttatattctatcgcaatgcacgacactctactatcatatatagaactaatgattgcaatgtgctggtgaaatagttagattaaaataacaatataacacacatttatacataatttaccgtgatattatacttgtgtaaactggaaaacgagaagtttctgaagtaaattagcttcaatgcccgactcttcrtgcgaactggaaagacacttttgtcatttcgttttctgaattgtgacctgtcagattccagggcgattcagcgcatgctgcacgcaccaggtattttaaggggtcacacttgcttgtttcatgtactagcacaagaagagaccgtaccacttcctcgagccaaatcgccagcaatccacc

SEQ ID NO: 13436 - DNA, 1455 bp, Zea mays
ggtaagtgattactactccaatgaaaaaaatatctgcctggttatcatttgttttatgcttagcgcgttgattggagcagtttgccttgcccactaataatctgactaaaaatgttatttttcaagttgcacgttcatgtgactatctgatatttttgcctttctggttggctggggcctagggatggacttattgtgatgttgatgtgcctgtctttggttgttgctgtgtccttgtgtgcagacgtatagtatgagacagatccactgagatatgagatattataaatccattgtcagtcattcatagagcaagaatttggtcagtgagaaatttaacaacattatgcgaggaaaacaaaacgaaattctctgggacaaattccatgctgctgggtctattttcttccctctagtgatttctcttctatatcagtttgccttctccgtcatagtaaaacttgtctgtgaagtcacttcggacctcagaactcaaattagagtattgtgtgtgtacatagaacaatcctcgtcaaatttgccggctaacatgagatgagatgctatgcatctgttttctattgtcccagtgcaaacaaaaagtacaatcacatgtcatagatcgcagtacccaacaaaagttgctgttgcgcctttattgtcgcttacagttgatgcatttcttagggcccatgatcaacagaacatgagatagtgacgaggcatttaaaatgcactgcagtttggctcatgatcggacagctttataaaccaattgcatagatacagatatagatctgtagacatttcaaagtcttaaaatgcttcgactaagatatggagaatgactgatctgtaggaatataatctaaccatgatgaagagctctacttcagagtttactgtcattcagaattcacgctggtttgatcggacattatctatcttctggcctcctttaatttcagatgatcacacacacacacaaaaatgtgattcttttacttgtgattcatacatttgaactaaattccactattgtagagtaacaacctaaatgacgacagctttttgctccatcacaaattccagtctttgttgacggactataattaaatacttcaaatagctgaagagaattttgaggtttcgttgatcttttgatatacgtttcagaggaccacaccttgtctccatcttctatacctttatcacttttgactttttaatcgagtgacctaattattgttcataaaactatgcagatgatcatttttcatgattttttttgttctagcatgagtgctttgtgccactttatgcagctaatgatcccattctctccaatctttacttttcgacctgtctcactgaaactgtgctactaaaatttcacatttgtgtttcaccacactgaaactgtgacttactcatcagaattggttgacattgcag

SEQ ID NO: 13437 - DNA, 966 bp, Zea mays
tggtgagccagcggagcaacggctccctgcgccaatggtcgactctgcaaagtgctacagtggtgaacagtgtcatgcagaagtcagagcagtgaagtcagaggggcaccggactgtctggtgccgcaagaggccaaagcctccaacggtcgaccagctccagaccctaacggttggctgacgtggcagcgcaccaaacagcacacaatatctatccagtggcgcaccggactgtccagtgccacaagaggacaaagcctccaacggtcgaccagctccagaccctaacagttggctgacgtggcggcacaccggacagcacacaatatctgtccgatggcgcaccggactgtccgatgcgcccatcgccagcagccttggccaacggctaccaagtggttgggggctataaatacccccaaccattggcatccaagtttttcagatatcacattcaatacaagagctctagtattcactccaagacacaaattcaaaagattaaatcctctccaagtctcaaatctatctcaaacacttagtgacttgtgtgagagagattttgtgttcatttgtgctcttgtcgcttggattgccttcttcctttctcatttcttttctcaagtgatttgtaatcgaagcaatagacacctaagtgtgtggtggtccttgcggggtctaagtgacccgggagattaaggaaaaggctcactcggtttaagtggccgtttgagagagagggaaagggttgaaatagacctggtctttgtgactttctcaatggggactaggttctttggaaccgaacctcggtaaaacaaatcaccgtgttcactcgccttgattcttgtttgatttgttttcccctctcttcggacttgaatttaagtctaacactaaccccggcttgtagtgtgtgtttaaagttataatttcaggtttcgcctattcaccctccccctctag

SEQ ID NO: 13438 - DNA, 1500 bp, Zea mays
tctgaccctccgaaaattcaattcactctataagcgaatatatcatgatctaacggtttttacgcttatagtgataaacgatactattatcgacatcgagacgtctataataacttcattaattccatcttaaaaaattatcgacccagtttttgaagatgttgatcatgcatgtgcatgttcatagaagcttataaattatacaggtgagtatgcgtgcgttgaagcatatgagaataagcatttaactggaataactcctgacatccaaaggggtcaaggttgccttgcctataggctggcgaactcaaatttgtacctattctgtaagactcgatacatattgagctcgaagaagtgcttcaaaatctgacatgcaaaaaaaattgtggcagagaaatcccagattgcgtagttcacatcagctcgtggctctagctaagcagaaatcgctgcgcgtgagcgatagatgtatttgttacttggtgatgcagaaccttacagaggtcagcttattaatagtaaaatttccatgcagtctcttttcattgttcgaaaataattattcaggatctcttaaacatatatataattaggtgtgttattcctgcgctgatcgaaagcaaagaacgagcacatggtgtgtcagccaaagtatttagtatgcagagtgttcttgcgcatttgcgtagcaaagagattaggaagtgacatgtttcacgaaaatagaagaatgatgaaatgtacatatccgacaactcaatcctactacagagtacacatctactattggtttaaatttagacactattctttctgaatatccacacaacaagtacgaggctttccgttactgagcgagctggcccagcctcaagtaactgattagagacatccgtgcgactgagagtccgaccagtggggtccccatatcggttgcaccggtgctaacacccgagggagataagatcggttgtgcaggagtgagtggttaatgggccggcggtagaaccgacccaggtagtaacaggtaagtttcttcttcttcttttcattttatttcctgcttgctttttattttcctattttattttcaaacttcaaattacaatttgggttttgaatttcaactcaatttaaatggacaaacaaaatatgagcaacttatatttagctataaagttttaaagtcgtttgttcctgaactaaaatcaacgagaccctggttctccagtcacgcaccgtcgaactcgaacgccacgcgccgcgggtagcactagcatctcgcaaagcttcccttgcgcttgtccacgatcttctggtctggtccgaaaattccgaggaccgtagaaatagtagattagattgggttgtaacaaacctggaatcccttgagccggcactatatatgtaatgccatatggagggttgttctccatccaaaggtaggggctgcaggttctccatctcgcacattagaaagatcgcgaggacgaagat

SEQ ID NO: 13439 - DNA, 223 bp, Zea mays
gttcacaccatgccaagctggctcgccacgtcagtgatccgtgcctctgatcttccagccaatcatagtgcatctctcaattgaaccctaacagtataaaatcgcaggcgccgcccgctcccctctccaatatccctccattctcctaccaaaaatcgcagcgccgcccgcaccaatctcgaagtgttcgaaagtttccagacccccaaaaggcgaagcggcg

SEQ ID NO: 13440 - DNA, 417 bp, Zea mays
gtaggtgctcttcggtacctggtgaacacaagaccggacatagcatttgctgtgggatttgtctcacgttttatggagaagcctactaccgagcatctgcttgctgtgaagcgagtgctgcggtacgtagcaggtacttcggactatggctgctactatcagagaaggaagaaaccagcaggcttgaccgggtacagtgacagtgaccatgcgggtgatgttgatactcgcaagagcacgacaggagtggtcttcttccttggtggcagtctcattacttggcaatcacagaagcagaaaatagtggccttgtcaagctgcgaagctgaatatattgcagcagctgtcgcctcctgacagggtgtttggctggcacggttgcttgctgaactgcgaggagaagaagctgaactggtg

SEQ ID NO: 13441 - DNA, 239 bp, Zea mays
cctacaaaacaattttagttcttgactttaggtacccaaacggttttgggtcctttggcattagaaacaagaactttgggtacccaaacacaagtctttgaccccttgtgtttgcccccaacaaatttggcaactaccttgccggatttgttagtcaaaacataagatgcatcaaaagctttaaatgaaatgtcatgatcatttgatgcattaggagttttcttcttaggcaacttagc

SEQ ID NO: 13442 - DNA, 414 bp, Zea mays
cgcatgtctctatgaagcaaaaaatgccagagcacacctcatctctctctggcgcaaaaaaggtggaggaaatcttaaaaggtcatgagaattggtgcaaagcagagtttaggatggagccagaggtttttagacctatagcgaatttgctcaggacagagaattttttgcgtgacacacgtgaggttaagattgaggagcagctagggatgtttatgtttatgctatcccacaatgcaagcaccggaagactgaagaaagaatttcagcatagtggtgagaccattcatagaaaaataaatgaatagaaaaataaattaggtctttgatataattcctgtacttacccatagatttgtgaagcttccaaatgcaaatcaaactcatgtgaagattgcatctaacccttggttt

SEQ ID NO: 13443 - DNA, 704 bp, Zea mays
aatagccgtagcacccggcaagactgggctcaaggatccccgtgagcgtcaatagcggcagcggcgagggcaacgtgacgtgacgagtgcagcggtttcttgcctcccgtagggcctgtttgtttcggcttctagcagcttctggccaccaaaagctactgcgaactgccaaacgctcagcttttcagccagcttctataaaatttgttgcggcaaaaatcatctaaaattaacataaacacataatcggttgagtcgttgtaatagtaagaattcgttactttctagatcctgagccctatgaacaactttatctcccttcacacgtaatcgtaatgatacttagattctcctcacagccaaattctccccacagctagattttcagaaaagctggtcagaaaaagccgaaccaaacaggcccgtactcccgtatcccggtgggcgtagcgcgtctatcgtggcgccaacacgtggcaggcagtgcgggtggtgctggtgccgcattccaaatccaacatacccccacgccatgcacatctttcggccccacgccgcgccgcgccgcaccttgtgctggtggattggtgactcggcgtgtattggccacgcacatctttcggcccctctcgcgataaaccgatcaatcgagcaaccaatcgaggtacaaccgagggatcaatcgtttcgtccgatcgcccgcc

SEQ ID NO: 13444 - DNA, 605 bp, Zea mays
ccccgggtccatgaaacctcaggaccggccctgtatatacatggtcttcccttcactagctatatatagacagatcacatcggaataaaagaaatttatagaccaaatcggaaacctaaaaaccaaaaaccgagccattcggtctattcggtttcagttagcaggttcaaaatgtccggtcctactaatactcaccaatgattaagaaccgatctgccatattttaataaattatggaccggaataacacatagtgaaaagtttaaggagcgaaaatattttttttccttggcaatttggacggcacgcggagactggcagtccgcatcctcgtgaagcacgttgtccatgcctgaagagagtattctgtattcccagtattcctgcatttaaaagtttggtgagcgaatcaataattggcataaataatgctaccgacgcatcaccacatagtacgtaccatagtcatccttatcctatcgaattacctacatgcccaaccctcccactacatatatctgcaacgagtacatcgccaattcacaatgccaattgccagcaacccatccatactttcagctgttgatacaaaaagagaagagaga

SEQ ID NO: 13445 - DNA, 563 bp, Zea mays
caccccggtcgtcttcctctttgccccgcgcttgctcccgcccaagaagcttcccgcccatcctcggagccgaagagtcccgagacctcgcgtttttccgcagagccatcctctcttcctcttcggccactcccacgcccacctccgcggcctcttacttcttccgccgccgtccggcgcccaaggtcgctttcctcttccccaccaactcggacctcgtcttctccccgctctgggagaagttcttccgcggccccacccacctcttcaaccctctacgtccccgccgacccctactccgtcctcgagctgccgcccacgccatcctttcccccggccgctttcgtccccgccaaggccacgcagcgcgcctcccctacattcatttccgccgcgcggccgccttcttggccaccgcggttccttgacgaccccaaacaaccagttcttcgcgctcctgtcgcagtcctgcatcccgctccacccgttccccacccctctacaacgcactcctctccgacaatgctggccctcatagcccccaccgcagcttcatagagata

SEQ ID NO: 13446 - DNA, 119 bp, Zea mays
tcggtaccctggcggctgctctcttcagtgtactctatagcgattgtgcgcggacgccgtggacagttgctgatgggatccaacttgtctgacctctgataccagattgttagcgctcc

SEQ ID NO: 13447 - DNA, 1500 bp, Zea mays
ccaataaatccaccaaacaaagtgcgcacaaacttaacacaacatcaaaaaccaacggttcagattgctggatgacctctctcccatactccaatctaatcaacaatattatttggataatactcatccctcaccccttactgtcaggcacctaggaatgggtacccaaagaaagcccgggaagctcctcaagagcggcccattcgaccaagtcccctagcgagcaagtctgtgaagcggagcggacgaccaagtcccccgccaagcaagtttgcgaggaggggcgaatgaccaagtcccctaccgagcaagtctacaagacggggcaggtgaccaagccagtcccccactgagcaagtatgcaaggcagggcagacgaccatgtccctcgccgagcaagtctacgaagcggggcgagcgaccaagtcccccgtcgagcaagtctaagcgtggggttagagttacaagcacacgtcgaccatagtatcacatgacaacaagggaccaggcgataagacatagacacaactctcctactagggacaacctcagcactggagcctctaaagtagttggtatggtggaaacaatatgatagggcggtatgtcaaatggacaaatccacatgcacggagggaaaaggggaaccatgccgtgtttgtcgagtcccgagcctacaccatgggaaccgccgtgcattaacatagggacgtcaaccacgaaaccgtcgcagggacataagtaacaggtggccatatctaggagcactatttcatacgatcaggaaatgggggcatgccgcaccggatgaaggacttctctctttattctgtctcgctctccctctctctctctctctctctgaagagaaagcaatgtagggtccgacccttaggatataaaagtgaaggaccctcttcttctcaaggggagaggcacacaagcacacctgatgtaacacgcctcacaacaatattacgatcagcattacactggattaggatgaaagactgaaccagtataaaccctgtgtcccaagtttatcgttcgagtcccaacgactcatcattcagagcgagttcacgctagcccccctaccgaacacaaattttactgcccacgattttcggaaccacgacacatagttactaacttacggtaatatataatcaggtcctacatgtccgttttctcattgcgtcgcaaactgtttacattacacgactaaaaaatgttgcatcaattttgttaaatattctccgtccatgtgcaagacagactgtaatgaatctttaatttatgctatagtacatgctccgtcgatgctctttgccttcagacccctataaatagctagctaggagcgcaggaggttgcagccatcgaccaagctagttagctagaggcaataaggtagctgcttgaagtaaaccggctttgttgattcttcagctagctagtttcatcaccttgtccctagcttggagctagctagcagca

SEQ ID NO: 13448 - DNA, 1500 bp, Zea mays
gacacataactctttgttgacactcatatatagctacataaaatcacatttgacatagcgtttagactttacactaatatatcatatacaaataaatcaaactactacacatgtgttgtgagctggctgcccttgcgactgttgccgtctggctgggtgtcatctggctgctgcctgctgccgtgcgggcgtgctcgtgctcctgaccgtgcggaccagcaagtgcgaaatggacccaaggcgactgggtgagtcaacggctccaggctcagtgagaccgttcgaggttggcggcagtgggtgcctgggcaggtcacaggtcgagggactgaggtgtggctgatccgccgatggcctgccctaggttagagacggagtgcggctggccgactgtgcctatgcgggctaggctagttgaagttgggcctacagttgggctataattggctcatatttacatattttcggatatccacggaggacccgcgggtaaagtacagtatccgaacccgacccgatgttacctcgggtcgggtacaggtaagacccgcgggtgaaatattgtacccgaaaccgaacctgacgggtcggatatccagcggatatccgaacccgcgggtaaaattgccatccctactcccacgccggcaaaccagaagcaaacaaacgtcgagacgcgcccgggcaacaccgtcattttcstggccgggaagcggacacccgaaaaatttcaaaatccaagtgcccaacgggccgttttcgaaccggacgctgccggccgtctgatgggaacgatcggatgaccccggcggccgacggtgctttggagggaacgcgactgggccgcccgatccggtgccctagcccccccgcgcccactataaaatccgccccctttctgggcactcgctcatttcatttaccacaccaccttcctctcctcgctctccctattctggacggccgactcgcttctgtgaggtaaaaatgcggcgtggaatccttgttgcttgcgtctaattcggattatgtttagtgtccgcgtgggggatttatgtctggtggtagctgatttcgttttttaggttccgttttgttaggtttgaattttggggctaggtttgcgtcgatgtattcgccggtggtgttaggttttgttgggtgttgcggtttgcttagatctgcaccactccaaatttaggttcggcgtttgattgtcaaatcatgaatcctgttgccatttcgggatcctagaagttctcggttcctatttcgggatttgggtgttttggttttgttcgtagaatttcaggtagatctcaagctgttcctcatttccctgtttttcccggatttgattggtttctgtgctggtgcttgttattcctccatggatctggttctccactcctgtttgggagcaatgtccccatcattttctcgcttctaaccacccttcagctcccctcccacctgcagctaccggccttagatccagcc

SEQ ID NO: 13449 - DNA, 1500 bp, Zea mays
catactgatgttcatcattcgatctgtgacaagtgataacattcttctgttttctggtttaaaactttcaggtttacttggtcaaaattcagatgtgtaatgccaattcaacagctttatgttccttgcctctgaacactatgcctgtgtttggcctttttgtttcttattctcctgtatctcttgtttggttgatgtggtaatatcatactgtggcctaccacaagttcttgactgtgaagcccagacaaattgtagtcattgagttaaccagggttaagcttgttttatgttcagatgggcaggtaacaatagagaaggtcttttgttccttacctccaaacatttggtggaccgcagactccatatgtgtgtgtggccacattgtctccatcatcaaatagttagggcgatacagaggaaacacacacacacacactagtagtctgaatagtgaatacatcttacagatcatcaaactggccactgcaggaggggaaatgtatgcaatggccggtgaagaagagagcagatacccttgtcttggcagagataacatggatgctgtcttccggcagcaaggaagtaggaagtggcagacatgaggattagcagtaggaagaaatgaagttcaggtcctggaggcacctaaacgaactgatcaactaattactgtcacaaagacatgagggtttacttttatgtgaacgaataaaagggaattgatggggagtttttttttctttttcttcccaatagtttataggaaggtccaaacaccagtctcaggactctattttgtaggtgtttttttggagatgttcttaggggaccagcataaaattctgtgaagtttttgtttggaaggatggcaatagctcttcagtactgtgtcaaatcctaaaatttgacagccccctctgcatcctccctgcattctcttctccccgtgctctctctctctctctctctctctctgtgtgtgtgtgtgtgtgtgtgtgtgtgtgtgtgtgtgtgtgtccccctctctcggtgacaattgggtgaccaccatcactgccctatgcaacctgctgagccaatgacaacaatgcattcacatgctcttgaggaacgctctttcctcaatctgcagagcggcattttctcatgatcctcacaacgacgaagggccaagtctagactccgtcctttatccaatttggccctttcccatatatatcctatatattatgtgtataaaagatctggtccatgagtcggggtgctcatttggcccttgggatttgacagacttgaagtcctaccaaacatggccttaaacactacttatgtttgatgtctaaaaaaatgtttccataattgtatacaaccaattgtttcaccaaaaaaaggactaatgtcttgttcttcaggtccttgctgcaaaaacatcatcttttatacagtcattgtgcgcactggcccctttccactggcaagaagaccctgaagtcatca

SEQ ID NO: 13450 - DNA, 1500 bp, Zea mays
acaaggagatgatcaaaggcagctagctagctagctaggtggagaaaattgtggaaagaaagttcagtggggactgacagcagtgtcgtgtcctcctgacttgcgaggagaaaagagaagaggaacacgatttaagtgcgcatatttatttatatacatgttttggatgttttcttttggctcgatcagaaattgatcgtcgatatggtgcgaaggagataaggtgatgcatgtagaagaacatgcctcagcctctagcctctagcctctacttggtttatctttctatttcttcttttacaaagagaagagaaaagaaaagaaaagaaagaaagaaattgatgtagagatatgtggactgatatatatgctctgaaactgacccaacccaaggtgcagtgatggatgtggacgcctcacctgtcgcctccactagactctctttcaactttccaagctaagtgttgttccctgtagggttagctggggcacaagttagttaaaagcgctctccccctctctctctatatatgtatgtattagcactatatgctaataggcaggatatatatataatataattgctagtgctggctgcagtttatatatcgaccaatgcaagaatgaatatatatataggttgtagatgatcttcttggttcagctgttgttgcacgcatgattatttctctgctgatgaacaaaagtatagactgctgactgcagtttgggatcaggaggatgaaagaatcacagtcggatgcatgtcacatggtatgataagagagaggacgaaatgatatgattatcgatggaccaacgacggtgcatgatgaataaaaccacaaggaattgaattattgatggatatgcatgggggccgggggtcatcagtctgaatttcattcatcagctagcggaagcttgtaatttcagcgacaagcagctagctagcgcacaaataagtcgatagtcagcttgaaataaagatgcttcatctatgagctagctatgtgccgtacgtacgtacgtgctttaattttacttccgctggcttgtgaatgatcagcgtcctttttggaggccaagtcttgagaaagaccgtactgaatccatccttccttcacgccaaaacccaaatgtaggccggactcaatatacaaaccaatatatatatatatatatatatatatatatatatatatagccaataattaatattcttctaatagtataaagttagtagcttaattagaatgtctgcctgccagtgccagtggcaggcttataaacactaggagtcgtcccttccttgctctgctttcctctctgctagctagctcttgtcttgtcactgagtgagcagaaggagtgtgtggtggagtgcaaaccaaatcaaacgaagaaaagtgggagcgaggaggaagaaaagaagaagaagaagacgacgacgacacccaccaccagcagcaagcagcaatcagcaaccagcataacgaa

SEQ ID NO: 13451 - DNA, 1500 bp, Zea mays
gattatactgaaagagtctgaggataaatatcactttagaactacaaataagatgaaataaacttaaataagtgatattttactctactgccttttcaccataatccaactgaagtaaacaaatcaggtcttaattaggcgacctgggattttcgtattacccgacgaaaatctactccctccatctcaaattaagaatataaatggtattctaacttcgtatcttgctcctacgttttctttttaaaaaacatacacagcaatttttagtcattcaactttaaatctaactgaaatatgtaaaaaacagtgtcatatttatatgtctaaatataatatgtcatgtttttaaaaatatataaaaatttgctccgggacacacatgcatggccgcatgtagagatgtaaatggtatggatattattcatcggtatttaatccgattatatctctaaccgcgtggggacaacacgatcacgagccaccccttgaaaacaacaagggggcattcgcacggtcgcgccttaacgactctaaattcattttacctctgttttttgaactttgcatcgttgcctctgattttttttcgaaacgaagcctctgcttgcccctattattccgttataagcacataacagtgtcaagtcagcacataactttgcagtttgcaccaatgcccctcttattatgaactattacaaatttacccccactttgatataaaagtttagagtataagtatgacataaatgcaaccataaatttgagaatcaattatttcatattcaaaatttcaaatactttgaatttagtgaaaaataaattaaatttaacattatattttatcaaaaattgaacaacattttaattctaattttgatagcattttagctataatttgacaccatctatttcaaatgttctcaaattgatgacaaattatagctaaaattttgacgaattataattaaagtgttgttaaaatataatgttaaatttaattttattatcaaattcaaagtattcaattttttcaatttaaaataattgttttcaaaattatgattgaatttatgtcatactttatattagttgaagacatctgaacaccctagctaatagttagatatttttagtaaattagttaatagttatctagctattggttagctagttaattccactagtaattttttaactaacggactattaaactattaactatagtgaatttaaacacccgagtggtgagcaggggtaaaaatgcaattgtcccgaacaacaacgactactgctgcgaactccactcaaatcccaaatcaaatcaactccccagcctgaactgtcctccctggactcccctcgccattcatcaacgcccgccacagagggggatcccggcctcccggtgccgggagccaagccaagccacgcaccggccggccgcggcggatcggaaccttccccaccgctcgcccgccgcatttgaggagggcg

SEQ ID NO: 13452 - DNA, 405 bp, Zea mays
aatgaacagtaaccccgaatggttcacgcttacctgtattcactcgcgcgtcatacttggacttttgccttctgtcaagccgaaggtacaaatgtaattcaatattgttcatgttcattcatggtgatataataaagatatatcaataatgtcatatgattattcatgttatttctcatgctttatatgcctctactttcattaatatacactgtgatgatgaaggtacgtccttcataaccttcgtctgaagatcattatatcctaaggaagataatgcttcgaaggacgaaggactttaaccattaatgttttgtgttgccttgttcttaactcatatcatttgagaacaagtccccaacattggcgcccaccgatggtgaactcacttccactgttgagctg

SEQ ID NO: 13453 - DNA, 972 bp, Zea mays
ttgccacgagctcctccgccgttgcacctgatccacaccgagctctctgacrctgtccccttcccctccacaaggtaagatctcgctctgatgtaggaggaggaccgtacctttgaatctgaggaaatcttgaactgtgtcgagctagctctcgcgtcgccctagcctgatatatattgtaggagatatttcacacactagttagttggtgcacgcacgcagagagactgcagcgatttatatagccaccgatcgagctagcaagtagcgcaaaaaagactcagcgttgaattcgatcagaggcgggcgacggctccagcactcactcactcagctagaggctaccactgcactccactggcttgtggttggctgctgaagtgagcgtggaacttgcctggatgcaccacccatgcatcccgacgatcagagatctatttcgcgtggggggtggtggtggggacagtgtctgtccattgaccgacacagaccttagcttccttcgttgttcctcttgcaataatgcagcaagagcttgctagctcgaagagagtaagtgaggtggtggtacagctgcttctaaagcgtcgtcgtatagatcaaattaaacctggtgtgtgtgcttcgaatcagaattcagaaatgtggtttgtgataacttgccttttgttctcagttccatgagtcaaatagatctgtatataatagctatctccatgttttgcatgcttaagatccttataagagctatctccacttctatagatatgggttcttgggaggagcaagttagacaatttttgttagatgaggaagaagacgacgatgagttgttctttgttattctgcctgctataattccatacctctcagaagagaaagagcccatccacacctcctcactcactggtgctaaaaaaggttagagaaatccttgaaggacatgagagttggtgcaaatccgagttccga

SEQ ID NO: 13454 - DNA, 1278 bp, Zea mays
ttttccatctcgtagacaaccaatccccatggattgttgtccacagaccagcatcgttatgatatgaaagtgggtacaaccaattcctgacctcgcgcgagtgctagaaaatcactcgacttctaccgagatcctaattaattaagcagctactcgacctagcatactagtattcatctcaataggattcctgagatcatgcaactagggtttcaaacaactcctacacctaagtgcacattcaatcctacaatcattaagtatggtaaaatagcataaataacaggttatgcataaaccggggcttgccttccaaagcagtggcaggtagatcctctggtgcaggctctggtgttggatccggggctacctcctgagcagctccttgctctggcacgaggacgtactctccgtcagcgaggttgcaatctatcgaatgcaatgaatatgtatgtcatgatcatgcaggatttaacaactttatgcgaaaagaagaaaactaattgaattagtaacttagggtttcttggtcatacgtggcttttggtggtttatgcttgttggggaccttcggcgtccgaaggtcctcaaaaacaggatttaacagtatttctgtagtacaatatgtgaacaggtatcytcagactaaaatcggcattgcagcagaccggaataatacgaagcttgatacagagccgaaggtgttgagtaggaaagcttcggcgtaacagcagagagtggaaccgacttaaagatgaaaaggctattcagacctcaatagattactatagagttattgtcagatgtaaagggcatgaatgtaattttgtaagggctgtgtcccgtgtctataaataggtgaacagtatccccgtactgttcacgctgacttggcattcgctttttgcgtcacgcttgtacaatcatttccttccgattgaaggtacacttgttgttcaataatatttttgtttatgctcaataataataaatgattgttcatgttttcctttacattcttcatatttcatccttcgtcattatttgattaatttatgaaggtatgtccttcataaccttcgtccgcaagtcattatgtcctaagggaaatagtgcttcggaggacgaagggcattaacgattaacattttctatgttgccttgttcttaaactcttagcacttgagaacaagtccccaacattggcgcccacctccggtgaactcacttccatttcttgagctttttcaacaccttcggaaggcatcacccttcgtc

SEQ ID NO: 13455 - DNA, 570 bp, Zea mays
cccaaagtttccttctatcgggtggtgcacccaacagtccggtgcaccaacgaacagccactgttcatgtccggtgcgcgatctctttcctattctggcgcagacgaccgttgtagattcgtggcagttggcgcaacggacactgttcggtgcacaccggacagtccgatgcccccctgtcgaccattggcgcgggccacgcgtcgcccgtggattgcacggccgaccgttgcgctggcggccgttggctcatcggacagtccggtgcaccaccggacagtctggtgaattatagtcgtacgccgccaaacattcccgagagtggccagttcgtcggaagtcagcctggtgcaccggacactgtctggtgcaccacctgacagtcgggtgtgccagactgagctgagtattggctgctcagagccaagtccttttctccttctcttttctctgtttctagcacttagacagaatatgttagtactcaaaccaatgtactaagtctagagacataccttgttacatgatttgcacttcttgcttgtttgacacataaccaactcacttagt

SEQ ID NO: 13456 - DNA, 486 bp, Zea mays
ctgaggagcttctggaccagtaattgaaatcaccagcggtttttgtgttttcaattcgctttttttttttttttttcaaaacgtcagcacacaaaccatatagaattaagtgaatagcccttcggttgatcactggccaccagttcgactctggcgtgacataatgatgagggtttagtcggttgtgggcggcaaattattgtatacaaaaaaaactctaactaaccagaaaccaaaccttatccctgactaaattatactacgtattttgtaatcaattaagcgcggccgctaagcaaatgagccatcatcgcggcgatgagctcgtcctctctcttgcacgagccgtcctcccacgccccacgcatatatacctcggcctctcgagtctccggcctcacaacacacaacaagcaaagcgaagcgcgcgcacagagatctagctgagctactagctatagcagcagctgctgcaggtctcctgac

SEQ ID NO: 13457 - DNA, 49 bp, Zea mays
caatcggagcaagcagagagaggccggctcctcccacccccaggcagcc

SEQ ID NO: 13458 - DNA, 444 bp, Zea mays
gatgatgaagaawatgaaagtgagagtgatggagatatggctctatttgtaaagaaattcaataaattcatgaagaagaagaggcaacctagaaagtgttttgagtgacatcgccgtgtagaagaggcaacctaggaagtcaacctagaagtggctctatttgtaaagaaattcaacaaattcatgaagaagaagaggcaacctagaaagtgttttgagtgacatcgccgtgtagaagaggcaacctaggaagtcaacctagaagaggccaaacatcaagaagaaatgctttcaatgataggaagtgttttgagtgtggggaacccggtcacatcgccaggaattgccctaacaagaagggcaaagatggagatgataagaagaagaataaattctacaacaagaagaaagatggcaaagcctacctagttgaatgggattcgg

SEQ ID NO: 13459 - DNA, 1299 bp, Zea mays
actccgagcaaaaaaagtccctacgaattagagaatattgtgaaagaatataagatagagaaaataatttttatgtaaaaaatagatatagaagagaccactgaagatagttgcttgtgccacagacttgaataacctttcgtttgtcttctttgctcaaacgagatagagtaaagagttatttggggctagatkgaaagatagtgaatcagagttggaaagctagattaatagaccgtgatgaaggttttgtttggatgcactatttgttaaaattagttgtagacatctaaacggttcaactatttgctatttttagcaaatcaactaatattgagtcaactagtgttagctagttaattctactagaaacattttagtcaactaactattagatctaatacattcaaacatggtctaaatcactttatcaaattactcattttggttagaaaaacactcgtttagaactatatatttgatcaagccttaacaactacaagtatcaataacttctcgattatttggtttggaaacatataatgtatatctacatatttgtattgggaaaagtacctacacaattttataaatttgttatgtctgttttcgatggattgtgtaaattagggatacaaaattgtagatgttattatttgatattgtttataaagtgaagtttaaaatacaatatgtaatagaagatgagatatgtgatctgctggagatagtttatgaggttttagaaacacttttggctggagggattacgtgttacataaagtcaaacatacctaacttagattaattattatagcatgtcgcttttttagacggaggaagtgtagcaattagcacacccactttgacaagtgtgggtccccacgcagcggatatggtcacatcacactcagacagctgccctgcagagctgatgcgcctgagcctgggcccgcctgcgcggcgacaaaagaaaaccaaccccgatccgggagagattggcaattttactattattatttataggtttcattaatatatcatcaaactcacaaataaataaataataaacacagatgatcacactaattatacacacgagatgatataataataaacaactaaaattaagactgacaaaattacaaatttctcgacccgtggagccttgcaaccaaaagtccaaaaccaacctacgccatcatcatccatccatccgcttgtccctcgcaccaccaccaaccaaaaacccccaactgccgaggtcgccggcgactccgtccgctccgcgccacgggt

SEQ ID NO: 13460 - DNA, 1203 bp, Zea mays
gtagaggaaggtgctgtgcttccatgtggcagtggcatggcagtgcgtgttgtttagtgtaaccgacactgccgcgtgcccaccaacctcgtggagcatgcatctgtaaggttctccatttctttggggggtgagtgagggcactagtagcatggtgtgcagtggttgtgaggttctattgttgttgtaactacaagcaggtaaactgttctggacgacaccacgatgtatatgtacatatgaaatgcactgctgctgtgggatgtatgcaatgagccaatgagtaggtttatctcacaatcatcagctgatgctagctgatggcgatcctcctcttgtatgctcatgggtgaatcaggcgccgccacgcgcgcgcctggctcgagcctgagcctgtggttcggttgggtttctttttctggtggtcggtgatcgcttgaaatgtgattcgaaggcaagcttggcatcggctggcgtttcaattccaccacaggcacccgccaccaaactaatcacacgggccacgggtgctgtgcggtgcggtgcagggtgctcccggtaaacctactacacccacccaccacccatcgcggacgcaaaacgcaaatgccatgcgctccgccgacactaaaacgcaacagggactagctatctgccgtacaccacccaacacctgtgaggctgtgagcctgtgacaccaaaataattggatgctaagacgcgtaccatttcatggggctacttacactagtggtgttatttcatactgtacatgaatatccttttctgtaaatccaccaaaagaaaagattgacttgggcgccgtgttttcaaaagccactagtagtgttggatgtggaccacacaggagatgcagatcggacggtgggcaagcgcccagcaccacaccaccccaccccgcaccaggcccgggcccccatcatataacggccaacaagccacgagcgacacgaaagaaatctccctcccgttccctttcctcccccgctccgcctttccctttcctcccccttctcttcctctctcctctccttgggggcgcggcgagatcgggcggaggagccctaccgccccccctcgccgaaggccgcagcggaggcgggtgctcagctccgcggaaggttagaggtgcggggctgcgtttggcaccggcggtaggcgcgggagatccggccagcgggg

SEQ ID NO: 13461 - DNA, 961 bp, Zea mays
attttatggctaattggtatcgttaaatatttgtgtttccatcttctctctttgattgactcttaaaaattagtcaaataaagggagaagcttaaaatgcggtcatgtgtgctgccttgttttttttttgttaccgttagtaatacaaaacgagtgacaaaaataatatttgtatttgttatttatctactcgaataaatgtttggtccttaggtattcgtcccgttttaattatacatatattcgatttcggttgaaatatattagttatcatatagtacaacctactgtccatctgccgtcaggaacaagaaataagtgacaaaaataatatttgtatttgttatttatctactcgaataaatatttggtctttagatattcgtctcgtcttaattatacgcatattagatttcggttaaaatatattagttatcatagtaccgtcccgttttcagctgtactcgtgcagtcgtgctgcggatggacacgcgcatcacctgtcgctgggtcaaaggtatccgccgactgcaggtgctgacaaggacaaaaggccaaacgcgacgggtgacacactcacagtgcggtcgcgctcggctccgccccgcccgcctctccccattctcacttcttttcccccagttgcgttgcgtgcccctcgtttccacactttgttgcgctcctttagcgccggcggcccgtagcctcaatcatcatttccattccatccggtttcttccgacgacggtgtgtacagagagcaggatcggacaagtctctgctggtagaagcatggcgcagcgccggctgttgggcacggcgccggcgcccgcgggcgatgcggcgtcgcacggctcgggctccagccccgacgcgatgcggatcatggtgggcgtgctggtaacggtcatcgtctgcacgctgctctactgcgtctactgctggcggtggcggaagcgca

SEQ ID NO: 13462 - DNA, 1500 bp, Zea mays
gactgtgtggtgtgctggttgttggatatcataccagtttacatgtcagcttgaatgcttctctatcagtgacgcaaatactggcttgaatatctaacagtgttacatgatgcgagtgtttagatgtcaggttggacacacctctgtcagttttaatgcaagctagtggttgtgtcttgtatgttggtgatgcaaaccttcaagggctatctaatcaggatttgaagctgcggtattatgttgttctgtatttgatttgatgcttctgttgtttatgtctaagggttccatgccatttgggggaagctctccttttagcttcgaaatgcccgcaggttctctgcggggtgctcggatgttggggccctagagtaaatgcagtggtctcatagtacgaggctgtactttggctgatgggtctctcatcaatcgcttcctcacagccttgcctccaatgaccacaacattcattatttgtgtcttttaaatttgcgttctctcgcgtggcaaatgtttggagtttgagatagttctgtttgattattgtgtaattgtattgggccctgcattatatgcctttctatttaggtgattctgtatctatctttcgctaggttggtgaacagtgttagactatgttacagatttgaaaaaattattgacacgttgatttgggcaagcaaactgtattatatacctgtttgtcttgtttaaattctgctttactaggtagtcaatacactcatgctattatgttacagcggctaaggttgcctcggcacgtcaccatgtctgtctggtggagccggccaagtcgtcatttcttctgcatgtgtttttattgtttgatttggatctgttttctcttttgtgtcctatattttgattgccatcgtgtgttactgcttgattttttatctgttatctcttctgttgttcccctttctttctgtgatgcagaggaaagctaggttataagggcaatgatgatgcaaagtcatgcaccactctgaatgagggatttttctctctttgggctgacaagcaaactttctacccattgtttatctgagcctttacttacctgtgtgctttcttctgtctcctttttgtgtgctgcttaatgtgatacttagttcgttgagttttgtggagttagtgattcttgagaattggatgatgtgggtcgacagatccaactatgatgtgaactgaattttatttgaggtcaaatctaattgctgcttgtggttatcggggttacctttattctgttgttgcttttttttgatttgttgctttgaatcagttttgatgaatatggtttcagagtggtgaagccaatttgcagagcaaaggggccagataagtggcgatctttgcattgaaggttggcgacaacaaaaatgcagttctccgtgccgctcagattttcatctgttctgtgatggcctcgaacaagctgctacatcatctcttacctgtgataacctactccct

SEQ ID NO: 13463 - DNA, 373 bp, Zea mays
ggtgggtatgttgcccgtttgttggttagagattagaccagattgcgctgttttctatttccttaatccaagagagctttattcaaggtcaagtctttccatgtcactaagcaaggaatagattgaagtttctagttacctccctgccctttgtggggtatagtcacactattgtggatttgtggtttagagccaaataaagtatggctgtgacatctgcactttcttgaagggcaattactctgaagaattttcctttgtttgctgattatacttaaaattttagtaccaaatatgcataagttcgataggtatcttttctttgttgtaggttgcacagagcaatttgagagatctacttttgcaatgctgc

SEQ ID NO: 13464 - DNA, 1500 bp, Zea mays
tctgtccaccacctttattagatcggatttgaatgagctctatttgagaagctacatatattccttaagaaaattcatggcaaaagaaactttccaagtggcatctgcgcgctagcagcttagagttgaccattagaagtgttcctagtgagttacttagcagagatagtgctgcatggggtggctggagatcgagtcccctaccgctgccgagtctatagagttttattgaagccttatcttaaattttaaatatacacaatataatataaaagatgcttatatagcgtagcattttagttcagccactccttcaaaaaatttgatggctccgtcctatatatagggcttgttgcttagcgggacatgtttaattattcagttgagtagttgacatgcttgtatacgagtgtgattgtgcgtgtgtgccaactttgcgtcatattgctgctgctattcccgcatgcactcgtcgcgcctgtgcaaattggcaaaaactgcgaagggcaggcaggcgaactcgatggcctcgcgcgcgcctgagcgcaggccgcgcgggaggtcggtggtcggagagcgagcagctagcggaccggtcgcacgccacgcgctacgccggggggccaatgcaggcgggcgcgtggccgggacggctgccacgtcgcgccgtgggggccacgtgttgcggtgcgggcccctggcccagacgatgtggcgccgcggcgacggcacgggcgccgggcgcgtctgaggtgtcccacgcggcgtgcgtggcgcgtgcatgcacccctggatggccgcggctcccacgtacgcacgcgcaagcccagcacttgaagactcgttcccgcccttggccttcgcgttgcatgcgaaaggcgacccggcccctctgtctgtctctctccagtctccagacagagtccacagtctagacgagagcgcgcttgtcacttgcaggccagtcttatttaagagtggccaggaccgtgtcctcagcctcgtacaatacaatacaacccaggatctctgtgttccttctatactctgatgcctgtgtgtccctcgccctctttcttttgcctcaatatcagaagctagctttcttcttcatcgcgttacgatctcggtgaggatcgaacgttcttcgtcttgccttaaggaaaaacccctctgacctctcgatcgtcgcgggtaagctctaatctaagcaagcagtatagcaatggtctatataatctatattaacgtgtacaaagcttcagggcatatcatgcaaaatatatatctagatatatacccgctagctcggcagctaaataatcgaattcgtatcagcaatttaatagcgcatgcacacgcccacacacgttgtttcttctccatgcatgcaccgggctcccagcgcgggcgcgtcgtttgcttgtcgctaaattaataacggccggcaacgtgcggcgttctaatctgtgcttctatcgagcagcattgccaaccggg

SEQ ID NO: 13465 - DNA, 596 bp, Zea mays
aggcggccgttgaacccttccgaggggccagccttcgaacatctgacatgtagtgggcgaggagcccgagtgctctgaggcggttgttgaacccttccgaggggccagccttcgaacctctgatcagtaggggggctcgggacccgcttccttcgcggagaaggatccctttcggagtatcccctttcccggtccctgtggcaagagagagaaagaggaagcggaaaaggatacgaaatcgaatgacgtggcacaccttttttgacgcggtcatcatggcggaggcgaagcgtcgcctgcttcgcctgccaaaggtgtcgcatgttctgccgcagagttaatgcaacgggacgagtggttcgcggggtagccgttcgaggaacgggtgtctcgctttgatttttgaatctcaccgcgggttcgggcgaagtgttgaacgggtctcgcctgggcctttatatattcgagagagggaccggtgacagttctttactctgctgcttgcctcccacttaggttttcgcaacccgagggaatagccagagaaaggaaaccgtgcacctcgtcctctttgccaccacctcttctgcttggtg

SEQ ID NO: 13466 - DNA, 1500 bp, Zea mays
gtgtggcccagcggcgagaaggacgccgcgtccaacgatggatacccagcacggtgcgatgccccacgtcggttcatcgatcgacctttttcatttcaattgggttttctcgatctctggttttttctttccgcggcctgtatgttgatgagttgatcaccgacatccatgcatccatctcaatctctgctgctcgtgagctcgttccctgtgttggttagctgggatctattagggatggcagttacaaccacgtgtgtgggtggctatggtttttacattcactcgttgtcaaatttcatccatggatctacacttgacctgacccgctgagcacacttttagacagccgactgtccgcggtccggacggtccgcgacattggtcaggttgggttagactgagtttgttttaagcgagtcgggtcagctggcccatgattaggtctactctcacccacccacacggactcgacgttagaatatacccgtagagcctcgtctcaaatacatactgcactcttctttagagcatctaacagattatgtaataaataaaaaaatgttgcctaaggctatattcagcagatcctctatacatcttatatctcattatctatttcaatgtacactctgggtgtgattggttgtcgtgctagccacggccatgcctgctgcgtgcattgacaacacttgagcacgtgactggctccctgcgtgtgtagaagatggcatgcacgcgtcggtgtgattggctccctgcgtgtgccacccacccagactggcacacgcctgaccctagcgagcacgcgaaccaatcacaccctctgtaaaaagtgtcaactacagtttattgttccctattttacactacatgttggagatagtctaatagtgtggacatgatacctgccattactaggagttttgggagactcccttccagctcagcagccattgtgcgagaaataggatccccaaatagtgtattgtgtctcagtctgttgtttggttttaatccgtatcgacttctactatttatacaatattttgtattttgtttttataaattgtagctgtatcaatccgaaccgcttccgaacagctgactttgatcctaagctaacagcattatcacactgccaccggaccccactggtacaccgacgcgcacggacgctccccattatggccagctgcccagctacgcgtacggcgtaccacaccaccagtgcagcaccacactgactggacacagtagagcagagtagaagagtcctcgagcggccatcaccaattccccaagctatcttttttttttatgagcaagcaccaggcattccattgccagtttgccactacaagtagttgcagcagcagctaatcagtcagcaactaggcaccaaaccatcacttcactcccacctctctgcgccctgcacctgcacataggtactacgatcaccacacgcgcaccaagcccaagaaccgtgcgcgcgcc

SEQ ID NO: 13467 - DNA, 103 bp, Zea mays
tggcgggggggctccttgccgcgtcggggggtgcggaagaaagcgaccggcggcagacgctagttgcggacgcacgcgcgttgggggagggccgcgcggatcg

SEQ ID NO: 13468 - DNA, 73 bp, Zea mays
gcttggtgggtaaagatacttattttgcttcctacctgtgacaacatcagagcttcaaggttgacaaggcaac

SEQ ID NO: 13469 - DNA, 193 bp, Zea mays
ggtatgccttttattcacagaagctgaatataagtgcaaatgctttgtttgttcttagcatttggtttattgaattaattcattttgttggatttcaatccacataaattatacatcaaatttgcatattgtttataatgttgtcattgggcatgcatggaacattggaattaaatgttaaagtataatctta

SEQ ID NO: 13470 - DNA, 191 bp, Zea mays
ggtcgcggcggagcgggacgacacgcctccgctcaggctgctcgagccgccgcatagatgacgaccccttcccgcccgaggtcctcaccctcacgctttcctcgctcgcttacagacgccggtctcaccgccgaatttagaatcgctcgattgacggttatcgtctacgtacgtcatcgcattgtgtgtag

SEQ ID NO: 13471 - DNA, 1500 bp, Zea mays
tatctccctcacactccaaataggttgcttcaactatttaaatgagcaagagcactagtgtgggctggttggtcgagtatttataacctccgactcacgaactatttgttgtagtaactctaggcagaaaatgtgatcatcggatcatctgacgtccaaggatcggaccaattcttatggtctaacaagacacaatggtaactatgcacttggtatgtcgaaaatagtcatttgagttatggtccaacgaattctgttaagtggccatagagtatttcatgagcgtcggactactccaacgatcatcgtcgaataatacgcttggtgtataactctatgatcacgacaccattaagtctagatgctttcagcctagatgtctttgtttttttatctttatgcttttttctctagattggaattggttttggacacagatactgaggcgtcggactcactctgatttagaatagatctgcagttggtttcgggtgcgtgtgatgcattgctactgtgcgtttgttgcctcgggacaagtgtgaagtcctgtcatgcctaactcaagctcgagattagggtatatagtattcaatgtttgggatgcaccaactcagcgaaacagaattgatcactaaacaaaccgattttactgactttgttgagatggattgggatgtaaactagagtatccaagcaaagcctacagtgaatttactcactcgatcttaactctccttatgagtgaaacgataagctaggaaggcggcatctgtcaaaatgacaatgttttgagatacatactcgaattaaaatccagcagtaatgctacctttcaaaccggtagtgtttactggtatatatgactacgttactaaacattttcaagactatttacacggacgaaaaggtttgttgctaatttggcactgcatgcacactcaaaactaaacaatgtggcgcgcggccttgcctatgaagattgcatctgcagcaggagtcaactagctagctgagggtatacctcgatctcgtcacgcagacaagactacaagagacaccaacaactactccagtgcactctgcacggcgtagcaagttgcagttttagaaagatgattgcaggaacatgcgctaaccaaacaagcgtcctctacaccgatccgatcttgtgattagttttttatattactagttttggagcagtactacagtccaagcctaatctgcccaccgtcaccttctcgccaggctacgccgtgcgcgcgcattagtcaaccgatccagcgcgagttcaggcgctcgaccatatgggaaggcaatgcaagcaccaaactggagccacggcacactacatatacgcagctccgtccttgttccttcccatcgatcaaccacatccatagggatcggtaaccagcaagcttatcatcatcgtaactatagctagtcgcatttgcaagtctcaatccacatccacagggatcgctattagctttagcc

SEQ ID NO: 13472 - DNA, 1500 bp, Zea mays
taattgtgtcatcagacatccagaacatggtaattttttgttggaatcttttggtaaggggctgatgggaacatgtaaaaggtactttcagtgcctgaaaattatgctagtttttcatagtttaattcaaaaaaaaaaatctaagggtgtggtgtctaaatagagttcctttacaccactaagcccaatttgcttaatgatatattttaaaattattgaatgctgattccatgatatgttcccattcaaaacaagggaggacaaaagtgctgcattctggaataaacacatgggctagagttgttgacatatcattgcatgacaacaacaaagccatccaaatcaacaaaaataatctcattaaagtggtgcctattttgtgcctgagggatccattagtgttaaagggaggtttggaagcctggaaggaaacacaaaagtatgaagaggtttgaattgggacatgtactttgaatgttagcatgagatgggarggaattgatggtaaaccttgtttggaaccaaagtatgtaggttgtgctcaaatatagaagaaaaagaaagatatcttgattttcatatgaatactagtacgtgcatcatgtatgcagagctttttgatactgatactggagttttattattcacttctagttagttagttagttattcgaggtagtgatggttttattatcatgggtttgatgttcagaataggacatcattgaaccctacaagcactaaatgttgtgggtaaaatacctaagtttctaattcactgctgctgggcagatggcttgttcagttatgtttgatatgatttttcgcatgtgatatattttgctgatggtggtgtttctctagatgtctgttttaaatcatctgtatttgctgtttgtttgctaagcagaaactggaaagtgtaggataatttccagcagagggctcctgtcatacttgcttgtttccctaacgatggtaaggatgacatgctttgatatgctggtaaggaaagatatgtattgagcttttactacaatacacttcaaacttttggactgaagtttttcatatatggattattgctaaagtgctgaaggccgaagccaatctgtgacctgtcaattacttggacactaatgacctgtttggttcgctgcctaacttaccacagtttgccacacataaggttaggcaagtttgatcaacttaggcgcgtgtttggtttgtagtcacagttgtggcaagatttgtctcttgctgcgttggtcccactcatcaatgacttataaaagtgtagcatrattctcttaggcattgccaaaatgcggcaaagaatttgagcgcctaacctttggcatgtgtggcagaaaatatatggcaatttatgacaccttagccgtacaaccaaacagacgctaaaggtcccagtttgtataattgtgaggccatcatgaactgctatgcttttgttcgtaggaaacaacataagatatattt

SEQ ID NO: 13473 - DNA, 129 bp, Zea mays
ggttgactaagtggtttattttgaagtatctagtatctttctgtccttgtactggaggatataatctttacttggaagtttacgtgaaagtctctgtctaactgaatctgtcaggacaacgagccactc

SEQ ID NO: 13474 - DNA, 295 bp, Zea mays
agcgaggaaacggctcggcggctgacatgacgtaccagcaccgagtcccctacaggcccacggctccgctgcgtggaccgggcgtagcggaaagcggcgcagggaggggaaggcgtttcggctgttttctctttctttttgcctctttttcacctgctgatgaattgaatgaggtgtatatcgctggcgctgcctgccgttcagatgcgcattttctactaggtagtaccagggaagcaaagagccaaagagcagtggagatccagcagccgcgcctctcctttattttcttgta

SEQ ID NO: 13475 - DNA, 1500 bp, Zea mays
ttctctttacgggagccgggtgggcttgcggaatacctagtgtattcacccagatttatttatgtttttcagcagctgaagacttcttttctgctatgcttgattgatggggctgtgtcttcacccagttctgcctgtggcctgggctattttatcttccactgcgctttatgattttcggctcactctcgagcttgtatcccccggtattgtaataacattattcagactctgtaactatttgaagtaatgaatgtggttactagcctcctgagactagtaattgtatcacatttgagtcccaaaggatcgggacgcttcattttattagataagctttgatttgttaggtaagctttggtttgttagactaaaaataaggtcagactagtttgtttagaggatgatctcagttaatgaaagaaagcaagcaagcatttactggtccagtgagtactgttcacgcgtgaaccgtaccgtgccaccctccacctgttgccctaactctagacctgcggcgcccaaacgtcgtggtcctaatcctcgaccttcccctcaccacctcataccacctgagaaagctgcaactccaatagcaaaggactgcaatatagtaaggaatcttgatgactaggctatgattagtatagagtaaagatttggagtaactgcactgccaatagccttaggcttttcgcagtggtgaattttaaccaatacgctacttagatagagtttagaatacagtaaaaaactgccacaacggttttactggttaggctactctaaacttaaggggaagcaggcaagtagaaacgctatttctagagtacatgtagcttgtactggaaaactgtcgcacaatgcatacacataccaggaatgtctagatcagaggggagaaagaagaggttgttgggtggataaagaataaaattaaaaaagatacaatgtataatagttgacatagagtttagatatagagtaaatattacgagagagaattgtaatatatggtagtgaatcttgatgacgataacattatattttttttattaaggttataaattgttgctttaaactagctattcaaactgttgcacgactgcaatatatggagacagagaaaaattagaagagaatatatccggtgcacatggaagtttagtacacatggtgcacatattaaattaggatcactcattttagatctaacgtctctagttgtctaatatattttgctaaggacacacttcgacgtggtggaatgtagtgatagaagatgttatttataaattgcaatgattaaccagagacgttagatttaagatgaatgatgataatttaatatgtgcaccatgtgcaccacatatgtcctgccccgtttycaaataatccgaagcacatagcattacacatacgcactttctctctctactgtctgtctgtttctcccaatcctccacagtctctctctagagtagacccaggaaagaggcg

SEQ ID NO: 13476 - DNA, 157 bp, Zea mays
accctgagaagaaatgatcttgatgtgatgcattcgatagggaacaaaaatatcagacatcgatcattgcagtcatgttctagaactttgagagctgcagacgccgaacttccaggttttgaagtttgatttcagaaaatatatccatggaagtaaa

SEQ ID NO: 13477 - DNA, 1265 bp, Zea mays
cctccaaaacaatgcagagcagacccctagcatgggagttgctgaggtgcaagttcagatggcaagccatgcaagctgctgggaagcagtgtgtaataccccaaatcatatattgggtgaattaagaaagattactccaagatttgaatgagtatgtatttaaaaaattaaaataaaaagatccacatatgaacgaaattacacttagataaattatatttttatattcgctaaaggaattagttaagtcacatcttattatggttagtcaatagaaaatgtttttctatcaaagcaaatggaggtgaacttttgaatatactacacattcaaaatatttttgtcggcgtttcgaacccggggggtccctggaccgacgagtaaattgtcgccgcgtgccccagcccagatgggtcggcgcgagacggagcgcgaaggggggaagaagccagagggagacaggcgtaaaaggggaaacccgcgaccttcgtgtttgtcccgcgcccaggtcgggtgcgcttgcagtagggggttacaagcgtccacgcgggagggagcgagaggcttacgcgagcgccgtcccgtccttccccgcgcggccaaccctctataagagggccctggaccttccttttataggcgtaaggagagggtccaggtgtacaatgggagatgtagcagtgtgctaacgtgtctagcagagaagagctagtgccctaagtacatgccgtcgtggcagccggagaggttttggcaccctgttcgtgtgatgtcgtggtcgtcggaggagcgctggggccttgcgggaggatagctgtcagggccgtcgagtccttgctgacgtctccttgcttccgtaagggggctgagagccaccgtcgtcatggagcatgcggggcgccatcattacttgtttaccagggcgagccagatgggacgccggttttgttccccatagcctgagttagcttggggtagggtaatgatggcgcctcctatgacgtggtcggtccgagccctgggttgggcgaggcggaggctcctccgaggtcgaggtcgagtctgtcttccgaggccgaggtcgagtccgagcccctaggtcgggcgaggcggagaccgtcggctgaggccagggctgagtccgagccctggggtcgggcgaggcggagttcgtcgtcttctagggctgagcctgtgtccgagccctggggtcgggcgaggcggagttcgtcgtcttccggggctgagcctgagtccgagcccct

SEQ ID NO: 13478 - DNA, 99 bp, Zea mays
ggtttggatttcggtgaaacctatgcacccgtagctaggctagaatcaattcgtatattacttgcctatgctacttaccatggcttcaagctttaccaa

SEQ ID NO: 13479 - DNA, 659 bp, Zea mays
atcatgaaagattttgaattatttaggatttaaatttatttaacctcatacaatttatattgattaagagcaaaacgaacaagcccaatgtaagagttgggttgggaaggggatcgacgttgtatatgccgatatgtatttacagtggcgctgattggatgcctgtgtctgtatagccggactcacgtgagcatggcccaacacatatggcactttcgcacgtatctcgacattaaggtaaaagacttctgcaaataagtaacgtgcatcgatgcatacatgcttaatcatcttcatacgggtaaccgaacacatttagagagtcaacgtatgtagtgagtcaggctatcatcggacgtgcaaccaaacacacgaagtgtgatcgattacggacgaaggcaatcaaacaccaatgtaccagtaaacacggtctgatggacacccgtcgaagcatacatagtctatacaactacaacgaagcaagtacatttggccaagaaagacaaaacagcgatgcaaatacatgtgatggccgtggaatctacccagatctggttaaatgaagcccgagcattcgagttcgagcacactcacagccattcacattaacccatgaacgaatcttgtcggtagcatcacagaagcaagcggcgagcagg

SEQ ID NO: 13480 - DNA, 239 bp, Zea mays
ggtaagccggtcactttatagcaaaatgtcctatttctagtgacagtgacaggggtgatgacaagaggggaaagaagaaggaaaagaagagatactacaagaagaagggcggcgatgcccatgtttgccgggagtgggactctgacgagagctccaccgactcctcctccaacgaggacgccgccaacatcgccgtcatcaaaggtcttctcttccccaacgtcggccacaagtgcctc

SEQ ID NO: 13481 - DNA, 1062 bp, Zea mays
atatatataaagtaagattattattattattaactagggtttctcgtagaagacggacgaactttggagtggtcgtgccgtcgtggtggtgtggctattattgcttcagcggcatgctaaatcaaacgtttaactttgcgtccgagtcgtggagcctggaggaactttgcattaattagcccagctgactgcgtacgccagccaacgtatttctgatcgagaccgtcgcatgcacgcatagcgtacactgtcactgtgtgcaatataatataatacgcagattaacattatgataatataatacgcaacaagctagaccgttcccgtccgactgcccatttagttaaaacttgcgttacatgtcagtcacgttcattcgtctgattgagacgctagctagcttgtgatccggaaaaaggtctctgcatgcattattattggtaaggtcgtcagcgccgtatatatatgcgtgatgcatgtgttataataatatgacaagtaaattagagattgatgcacgcagtagtaattaagacaggcatcgtaatccccccttgtttttggtttagtagtaaatctgcctgctgctctaagtagtagttaaaaaaacagagaagcggggtgggctgcgtataaatagccggccggaaagggggaaacgggcaggcaaacaacaacacacactcgcgagtcgcgagcacagatcgaacactaacaggcaggcggcctccgatccgtcgccattgtctcgttgtgttgtcccggaggaggaggagcagcagcaggagcaggagcgatcaggtgggggtgatgcgctgatccgtttctccccttccccgccgcgatttcctcctctgcttttgttgtccttgtcgctgctgttcacccccgcctcctcctgctgctgcggcggtggattctgttctcgtatgcttaaccagtaccacggaccttcttcccgcaggccaacgctttggactcctggacctaccccgatggcgccagcctcctctccgatgagacagtaatccagcgagcgcgagtgagagacaaccagcaacc

SEQ ID NO: 13482 - DNA, 1317 bp, Zea mays
attaaatgagttctggaattatttttaattattttctatattttttatcacatttactagctatctgtaccatgcgtataaattctgtaaagaccggggttgaaaccatagattccaggacgcagttgtaattattttctaacggttgcggatggaaggttgattctagaaaactttaagggcctcaatgtaaaactactcgaccaaaggggtatcaatgactcctgcccgtccgatcaaaatcggaccgcccagattagatcagcccaccacgaaccggtacgtaatatcaaccgtgggattggagatcgacggttcggatctgaagccgatccacccaatctgcaccagccctaaaaccctacgatccagatccaatggccataggcccgtcttcatccctcagcctactatccagacgcagacacgcaggaataggataaaggctgtgtgcagccatcgagggtgccccgccggcgagggacgttgggtgcgcaacggtgccggatgttgcacgagcgcccagctattcaagagcgtggccaactaacagaggcggaaacacccaccggagacgaagcttgcccacaagcgcaggcgagcataacggcgaaactacggcggcttctccccaattctctctcttctcttttctgctgcaatgccgagggtgcgagacagcgtgcagggagcgacgagcatcacgagaggccgctggcagcttggggctagatcctagagaggtgcagaccagagccgcgaccgaagctgcaaggcggaaccccgtcgagacgatggcgagctcgagattgtggccgagacctgggcatggacgcgaagatggcagaagcaggggctcgcacgtggtggaggaagggacggcgcacgatttatatcccgaacacaggagtccaagcgagatccgcccgcgaggtcaccgacaatggcggacgccgttcgtttcgcccatcttgttgtgactaggtgtgtgctcgtgcgttgcaacgggaacatataatatcattataacttatatataaatgtgttacattgttatgagaagattttgtaatccattggtgatcctgcctatacatataaattttgttatttcaatctacctgtttcacaactacattgcaaccatcaatatcatgtagacctatatatattatagttaggtgtctgtgcgttgcgacgactcacaaatctattactactctataagaccctattgtaggcgttcacaagtgcaccgtggttctgcccgtcctccccctcgtgcaatcccacgaatcatcgccactctcgttaaag

SEQ ID NO: 13483 - DNA, 1500 bp, Zea mays
tcagccatatggacccattccgtccgttagatatctgacagaggggacccaggtcctgacatgtgggactagtttcttttttttcccccaaatcgaagaaaacgccgctgcttgctcgaagggatctcctgctcgtaccagatcacggtcgaccgccgccgtcttcttcctcgagcagcgccagcagccgtcttcgccagcagcacatctccaaccaacgcccgcccgctgaagtctcgctgcccggcgcgctcggcatggctctgtcgcatccgcgctagcaatcctgccgcagcggcgcgtgcgggtgaagcagcggccaacttcttctcgagcagcccctcttccttttcattttcattttcagattcaaatccaaattccagccaaataatttaaattcaaatttgaattccaacaataaaaaacaatgctccaaaacatgcggtgcacaaacataattttatatttacccaaatatttagtttagaaaaataatataaatgtgtaatccacatagaaagcactccaatttaaataaattattggtgatctttttatttaatcttcaaattaagaactttgggtgttacatctgggccacctgctggagcctttgagcacgacgcgcgattagtgtttgacgaagtcctgagccggtgtctagaacctgctatcgctgtcaattgaaaacgatggttcatggtttgtgttttatttatttttttactaattgctaattcatgactggtatcctaaacggttgtttagacagtttaaacaccgtttaaatgctactcagtaactaaccgtttagacggtttatgttgtttaatccggtataatccaatccatttaaacgtctcgattacacgctaaacaaaagatgacccaactatttacagtttagcgtttatggtgccgggtagttgatgctgacatatcgaagctaaacctctgtttagttagtagttgttgtttagtaaaataatatattttgttaattaagttggtatattagagaggatgagatatatagaatgaattttagaggatattcttgaagacaagaaggatataggagacgaattttttgatgccaacgaggaatatttttttttattagaagacgctactagaaacagtcttaaaacttcaaagcatccgtcctcacgcccgagtgcgtttggcgctttcctggctttatggacggctggaaagagagagcggtggatggcatcgattcgtccgctacgtaaagctttggtaatataatactccgtactactccatacggcagcactcagtggtaatataacacactcccagtctcggctctcaagcaggtcgcccagcttccacggccgccgccctccccccgtcccttgccacatcccggttcgctgacgccgtcctccgcccagcactccagcagctagctaataattcatctcgagatcaaggctgctactgtagggctagctccgcggcttcgtcgcc

SEQ ID NO: 13484 - DNA, 679 bp, Zea mays
attttggtagttcggtatttaatgtatgaaacggctgagtcctgaaaaattcggtattttaaattttttggataacccgaatatctacactttcagagtcatgacaaaacaactaactacaataaatgaaaacaatgaggcatttaagttagtcaaaccatttttaagatagtatttggttctggagtacggtrgtgtagagcagtaccgttctcaatttattgttgtttgaattgcttctatatgggatagagtgactctaaaaaaagaaaattatgtttaaatattattgaagcatctagctcccaaaaaatctttcggacatgacagtttctagcatgaagctgctccatccaaactaactttggaaccaaacactactaaaaaactccaacgattttgttgattagatgtgaaacctaactacctatcaagcttggtactctgttgcgtcattcattcacgattaacgctgggcctaaaagtagcacgccggcccaacccaagcccatgacaccgcctccgcgcgcacaagtgataaaaccgtttccaccgccgaaaccggagccccaagtgccgtctcgcccccgcccgccactcaagcactcccttcccctgaactaactccctcccgcctcacgcccacaaaaaatttctccgcttcccgccctcctcccca

SEQ ID NO: 13485 - DNA, 80 bp, Zea mays
ccttccgagactgaaaaagtcctgcctacggactaggcttacgccatagccgaacgagcagctcagagcgttttgatatc

SEQ ID NO: 13486 - DNA, 735 bp, Zea mays
atccatatccttatgcatacccaacccccaccatacgtgccaaatcaattctagggaatgccactatatccttatgggatgccatagcacctggcttgggggcaccccaagtgtcggcgtttcgaccccggggggtccctggaccgacgagtaaattgtcgctgcgtgtcccagcccagatgggtcggcgcgagacggaacacaagggggaaacaataaggggaatcgcggcctcgtgttgtcctgcgccagggcggatgcgcttgcagtagggggttacaagcgttcgcgagggagagagagagagagagagagagagagcctgtgcgtcagcccatcctcccgcgcggccaccctctcgtatgagggccctggaccttccttttatagatgtaaggagaaggcccaggtgtacaatggggggtgtagcaatgtgctaacgtgtctagcagagggaagctagagtcctatgtacatgccgacgtggctgtcggagaggttttggcgccctgttcatgtgatgtcgtggccgtcggaggagcgctcgagccctataggagcacagctgtcggagctatcgggtccttgctcacgtctccttgcttccgtagggggctgagaactgccgtcgtcatggagcacgcggggtgccatcattacctatctggcggagctagccagatgggacaccggtcttgttttctgcggcccgagtcggctcggggtagggtgatg

SEQ ID NO: 13487 - DNA, 1294 bp, Zea mays
actgacatgagaaaaaaatgcggaccatcaatataataatgcccttgcatagttgcacacagaataacaagtgaaggaacccatgcatgcatgcactccgtagctaggtagcataaagatcttgtggaacattttgaagcattattgtcctagacgaattaatttgtgaagttaatagcttgtgatttcaatgcgttctagctctctctatccgcgtctttgagcgggtcttctgattctcgttaattagagagtaacttgttctatggtcactttaagcgacaatactcatttacaagataattgtaattttcttccaggtgatttacgataatatatcatgctaaaatttgaggtggttttttccctggaaaactgttgggttggcaacccgtagaattgaaactttgattcgagcctattttcactctccattttttggcctaccaccaattcttactgtaacaccatagaacgttatcgaatctttcgtctcctagatcatgagcagcagcgggcatgccagcaagctccacacgctggtcggcccacatgcagcagccaacccacatgtgtccggttggttttaatccgtaccggcttctactaattttatagtgttttatctttatggatgattatgacagacatatattgacaagaaggaacattagagattgattttgcaattttgcttctagcaaaactatctttcctgtgtcttaaataacaatgtcaggcaaccccggccctcacagatgggtttaaaaccaaatctcttaataatggttaaaaaataagggatgataaaacttcttggagaaaatatactaacaacataaaggaaaaaaacttctcagacttactattggggatggacataaactaacgatgtaaagcttcttggaagaaaaagaaacccattataaaaatgctaaaaaaggacgaataatgaactaaaaaactttaagttaacaatggtagaactgtcaaagcgttcaggagaagtaggagagagtgtacaagaaagtatgaaactgaaccttattagcttatcaccagctgctggagaatcgacagagaaaagaacacatcttgatcggtgctgcatgcatgtggaagatttatatttgtctaggcagcacgcatgcatctgcacaggatgaccaagttgacggcaccggccatgctttgctgctctgctggcctctctctgcagtttcccacagctttattgaactgcatgcacctgctgatgcgggtggaggagttgaagctgccgctcctctgagag

SEQ ID NO: 13488 - DNA, 587 bp, Zea mays
ttcgaacctctgatcagtagtagggcgcggagcccgaacgctctgaggcggctgtcgaacccttccgaggggccagccttcgaacctctgatcagtaggagggctcggggcccgcttccttcgcggagaaggatccctttcagagtgtcccctttcccggtccctgtagcaagagagagaaaggggaagagaaaaaagggatgtgaatttgaacgacgtggcacacctttttttgacgcggtcatcatggcggaggtgaagcgtcgtccgcttctcctaccaaaggtgttgcctgtcctgccgcagagttaatgcgatgggacgagtggttcgcggggcagccgttgtgcgtgcgcgagccgttcgaggaacgggcgtttcgccttcgagtttttgaatttcgctgcgggttcaggcggagtgttgaacgggtctcgcccgggcctttatatatttggaagagcgactggtggcagttctttactctgccgcttgcctcccgcttaggtttctgcaacctgagggaatagccagagaaagaaaaccgtgcaccttgtccgctctgccgccacctccttcgcttggcg

SEQ ID NO: 13489 - DNA, 1500 bp, Zea mays
tctcaatggctcctagctgccttggggctataaaagggacccctaggcgcatggaggagtataccaagcattctctaagcattcctaagcaccaagacttcgattccgcgcatttgattctttgtgatagcaactagagctccatttgagttgtgaactcgccgggttgtgttgtgagctcttgttgtgacttgtgtgcgtgttggtactctgatttcgtttcttgtgtgcgttgctcattgaaagggaaatgtgcccttgggccatttctaagtattttggtgatttagtgtccaacacaagtgcctaagtgttaaatggtggacaaagtacaaatcaagtataaaggtatgtttctcagacttagtacattgttttagagactaatgtattgtgtctaagtgctggaaacaggaaaaatcaagttgaaattaaagatggctttgttcagccaaagtcagctctgtctgggtgcaccggactgtccggtggtgcaccggacagtgtccggtgtgccaggctggctcaggcgaacttgctgctttcgggaagtgattaatggcgtacggctaaaattcaccggactgtccggtgagccaatggtcggccgggccaacggtcggccgcgcgatccgcgcgagacacatggccgagccaacggtcgggagggggaaccggacagtgtccggtgcgccaacggctcccaggcgccaacggtcggcttcgccaaagaaggaaagaaatccgcaccggacagtgtccggtggtgcaccggactgtccggtgcgccaggcgacagaaggcaagaattgccttcctggaatgcactcaacggctcctagctgccttggggctataaaagggacccctaggtgcatggaggagtacactaagcattctctaagcattcctaagcaccaagacttcaatttcgcgcattcgattcttcgtgatagcaactagagctccatttgagtagagaactctttgagttgtgttgagagctcttgttgtgacttgtgtgcgtattatcgctctgattttgtgtcttgtgtgcgttgctcatccctcccttactccgtgcttctttgtgaacatcaaagtgtaacggcgagaggctccaagttgtggagatacctcgcaagcgggatatagtaaacaaagcaaaacaccgtggtattcaagtgggtctttggaccgcttgagaggggttgattgcaaccctcgtccgttgggacgccacaacatggagtaggcaagtgttggacttggccgaaccacgggataaaccactgtgtctatctgtgattgatcttcttgtggttatcgtgtcttgcaagaactcttctctagccacttggctttattgtgctaactcctaatcaagttttgtggcattaaagttcaagttttacaggatcacctattcacccccctctaggtgctctcaattggtatcagagccattctcttcaagaaagggactaatcgcccgaagag

SEQ ID NO: 13490 - DNA, 281 bp, Zea mays
aggacgcagcgggtctcgtttccgtactcgtagcaggtaatcgcggagctctcctcctcctcgttctttgctctgtcagtggcgatgctactactattggttcgatccctgcttaggtttgatctagggtttggagtttttgaggtgatttcattatgccaatcgcgttatcgcgcgtagttttgttttggttttaatcgggcgcttactgttgacgaggtctgattaaaatttcaactttccaggaagtttcgcgcgagggattgattgtcgagctagag

SEQ ID NO: 13491 - DNA, 546 bp, Zea mays
aagcttcggaattacaaaccgacttaaaagtagaatgaccttttagtccataagtgtttgagtcgttgttgtaaacttttatgaggggtatgattgtaattgctcacagactgtgtcatgtgcctataaatagtgaacagtattcctttactgttcacgcattcctgtaattgcaatcgcatcactcggagattattctttgccaaggcagaggtataaatgtatctaatatttgagtacatcaagttgatttaatatgaaaatgatgttgttcatttataatttacttttctttaatgcttcatatctcgaattattttatgtaatctattagagttcaattacgaagattcaaccttcgtaattgtattgtccttaaccttcgtccgaagttcattaaatccttaaggaaataatgcttcagcggacgaagggcattaacatttaacattttatgttgccttgttcttaattcatagcatttgagaacgagtccccaacattggcgcccacctccggtgaactcacttccacttttctgagctg

SEQ ID NO: 13492 - DNA, 171 bp, Zea mays
aggagcttacggaatcgtttgctcatctgttaaccgcgagaccaatgaaaaagtcgcgataaaaaagataaacaacgtctttgacaaccgtgtggatgcgctaaggacgctgagagagctgaaactccttcggcacctgaggcacgagaatgttattctctcaaggacata

SEQ ID NO: 13493 - DNA, 147 bp, Zea mays
cggcaaagctaattgttttaggaaacatgatcaaggagtgatatggtttaaagacccatagtggtgccaaatgatgctaaagttcgtcaacaaaaacttgatgaagctcatcttagtcggtattccattaaccctagaagcactaag

SEQ ID NO: 13494 - DNA, 200 bp, Zea mays
agtcagtcagtttcctctgtcgaccagcgaccggcggcgctgcatgctccactaacttgttcctgttcctgctccttctccctccaggggcgccggtgctgctcaacaccacgctcaagttttgcgcctcccccagcaggaacagcagaggctgctgcgacgccaccgctgatgccgcgctcagcaagcagttcgacgcc

SEQ ID NO: 13495 - DNA, 495 bp, Zea mays
cccctaggacgatgaggtgattgtgctcgtgcccttctacgagtgagggttcgagatccccatgcaccccttcgtgtaggggctaattttcttctgtgggctagtgattcaaaaccatcatcccaactctgtcctgcacatggcgtgcttcatcaccttgtgtgaggcgttctcggggattgacccccactagaatttgttggatcagccaacttccaactccattctagccggaaggcagggtacttcaagatcccactcccctcctcctkgcagtatgagggtgagtggttctacatcaagaacacggccggcagcgccccatgcttcaccaatcgtgagccagttttgacggatgactggcatcgtggggcagagccgggtctagaagatgaggtggagcctcttctgacggtgttcaagacattgaagaaacaaggtctcaccgacatgaggcttgtgctagtcttcatccatcgccgaatttagcatcgg

SEQ ID NO: 13496 - DNA, 1068 bp, Zea mays
attttagcacttagagacctaaacataagtgctaaaataagtgatatgctaaactttaacttttaatagaagtttagcccctcaagatatgctaaattttagcaccccgcgcgtgggattcaatcgtgaaaacaggcccttattaatcaccgaaataaaaaaatttatgtattttttgcctgttgcgttactgtcaccgaccatcaatatctttttttttcttgggaaaaatatgtttttgttatcacgtccttcagtgcagacgagcctgtaacactttattattcccttctctgattgtcttcatcttttcttaagtgttactagtaatgagtacattatttcgatagcatgtgaacataggagaaaataactaacagcaagatgatacttggcgctctattatataacctatacaaaaaaaaagtgcaaagatgataaaggatggtctatgtacgaggctggttaataatctgcttttgctttcattttacattactgagatctgtttgcagctaaaagtgtagtgctctagtacttagcatatctgaacatgttaagatcacccccatatggttactaaaagtgaagcttttgcagtttttgcttgatgcgccgaacagaatcaaacaacccaaaccagctctaagcccagtacctgtttcccgcactcttctttttctcgcccctttcctgacttaataaatagttaaatcttcagatcttgatcatatgtcactcttactaaagcatccatttgtgctgttctttgatgaacaccctaccctggtatccagtgactgccataatggcttcatgtttatgcaacacaagacaatcgtctctttctccttgatggcatcgaacgctttgctctttatcttctttctctttccctttgattcgtgttccagctttagatttgcctcccgccaagcaaggcattttgtgctacccgctttggcaactatataagcacgcccaagcaatccaatggcagcagcacacaaccacactcgcattgcattgcattacttgaggtgggttgtgtgctcttactgagcgaga

SEQ ID NO: 13497 - DNA, 1500 bp, Zea mays
gaagcgcgtttatgatggatggaaggatggggatgggggctcgatcgatcgggatcgccttcctctgctgcttgcaatgcaattcatggatggaggaagcctgcctgtggcaggagtacagtgtaaaacactagtgtacgtagtatggcatgccctgtgctcccatgtgtgctactattgccgcgtcgtctgcaggctttctccggcggtggccctgctgccctcgaagactggactggagactggacattgggacaccggcgctgcaggagcctgccgaacgtattatttgggcatcaatggtttccctatcgactggtagcttggggggcgatgcgtgcagtgagttttttcctgtttgaaacaaaatggttttatgataccccatagacacaattaaaataagctggtcgggctttttctccgtcaacaagtaggtggaaatagatgtaattgtccgaaacattaaaaccgaatttgctcaaatccaatccaatgaaggcagtatggaacccgctgtgtgtcaatgctgggcaaaccgtaaataatacgaccagcaggctcgagagccaagccagtgtgcagtcaggcagtctttcaaggactcgagggcagctgggccaccgccgaaaagcctgtagacgcggcagcagcttgcgagagcagagaggcatgccgcgccacggcgccctgcccccagtgctggtacgcgccggtcggagtcctgcagcgcgcgacgcccgacgcctgggtccctcgtaggccgccggcgccaaagaaggcgtggagaacggagattgcaggctacgtgttgtagagcacaggagctagcgcgttgcgggacgacggagacgggagacccgggcgaggggcggcagcggcatgcctgccgctcagtgcagcgtccgcaggcttttcggcgggggggtgggcctggcctgcccttggaacgaatggacatcggtggtggagcctattgcgcaacgaatgcgagcgcaggcgggcgtcgccatgccgcgcgtacaccaagtacagtacacagtgcacggctcgtgtgtcgcatgcatgcgcgcactgtgcccgtcgtgcgcgcgccggccgactcgctctctcactcactccccccgatcctgcgcagcggtagagccatagaggaaggagggtggaccaagaaatatttattatggcctgcggcctgccatgccactctgcctgcctcgcgtacagctccttttccatccagacgatgccaagccatggccgcatgcatatggggggtcgccgggtcgaaacccaagccgagcgtgcacctataagtactacgtactctttactacttgcatccggccagccactgcctttctcccaccaccggcgccgtagcttgcttttagttagttaccttctcgatctgctgccctctttccatcgtctttgccttccgcggcacacaggtccttccttgtactcaggcctcttcttttctgaattctgagggcc

SEQ ID NO: 13498 - DNA, 114 bp, Zea mays
ggttgacaaagctgtacaacattccaagcaatttattgtatctagtttgtagcttatactttttcacttctccatttagtgactgcattatgagatggtgggaatggctccaac

SEQ ID NO: 13499 - DNA, 1500 bp, Zea mays
ttttaagtgggtcgtacataaagcactctctttctctgacgtgctatggcccttaacgacaacaacaaaggcaacaacaaaaaatataacaactgtcacatcaaaatctcatggtctggaaatcgtgtcttcgttcgtttatgaacactcgaattccccctgttttcggttgttactaattctaggcctgtgaacactcgattgttgatgctctttgaaatgcgacctatacaataggtaggcagtccatcatgtaattttagatctcaacaaaatttgtaattttttcagattgtcgttttgttgaaaactattttagaataaaaacaattgacatattgttagatttatacagaaatacaaagtgaacattattctcattgaccactttaaattctagagaggtcaatgcaatatatatttacgtgtttacgtcgatgtcaatcaccctttactcaaatctcacctatacgtgatatgtgtcttaggtcctttttgggttctagtggctaattgtttgttggtaggtaacaattaaccaacaaataattagctagcaacaattagccagggtgtgctcaaaatcttgactaatagatgtctttttctttttatacgacctattagcatctattagcaatgtcaaatagctaatgagtaaacagtttgctataccttcgactaacaattagttaatttatcagttagtctgtttagaggccaggatgtttaaattagcccgagactatttgccacatggatccaaacacctgattccaatgatacgagatccccacacgtccgattattgggttcagcagaaaattcatggctccgctacaacgcgtgcgggcacatatctcgtgaattacaaagtcaaaacactggtgatcccgtgcaattttagtacaaatatcatatccactcgaactcatagaatcatatacattgcgcaaaaaagaaagaaagaaagatttagtcattttgaaaggcgaaaacgaaaatttagtaacagaaatgatgtttagatcatgattttcgttggcaagaggagtatacaaatcttttgctgtgccaatttaaacgaacaaaaaattgtataaaaatataaaagatccgtaaacacttcagtgggccttggttttgtcaacaagctcgcttctaataatattgcccaaagcccgaataaaatgaggcctgtgaagtcatcgtggcccacggacgtgtaggaggggacacgccgccgggcctcactaaccgcaggttcgggagtactccggaacccgccgccgcatccacacgacgccacgactgacgacggagagccccggtctccttccacggctccaccgccaccaccccgcataaaagtagggaagagagccttgcagcgagaaccgtatcgatctattctcgtctgaagcaattcgcccctgtcgtgagcagaaccctacagctcgtattcgcctcatctcgcagcagcagcagaagaacaagggt

SEQ ID NO: 13500 - DNA, 59 bp, Zea mays
tcagctcaacgaaagcagactgctcgctgctggacttcgccaaggacgtggacgcgctc

SEQ ID NO: 13501 - DNA, 509 bp, Zea mays
acggccttcttatgccgatactagttcttaggctccaccatgggtgttgaaagctgaaagatcagatctgatggatgcctgaccttcttcgaacctcagttgtggttcttgtaatttgcaccgcatttctgttctgagtatgttttttatgagaagactgggaagatgacagacagatactgtatcacgtgatgctcgtaaattaacactacctgtgaattctgttgctcgattgctcattttctgatgcttccatgattgctgatatatcttaatccgatccgatagttataatttcacgggtctagttctagagatgctgaagagcttgcgcctgcttgcaggcatatgttactttcagcttgaaggatggccgtccgattctcgcgttcgatctggacggtgggtgattttgcctactcccgtccgtcgatgattcgtcgcgagccattcagaaggcagcaaatctagctatctcctctgcctcctgctggcggtcctgctgcgcc

SEQ ID NO: 13502 - DNA, 789 bp, Zea mays
caaggccttcccaagttctttgaagatgaattcaaaatctacaaatataagagtcttggttctttcaatcattgagtttcaataggtctcatatcaagtatgatcgaatcaagaaaagatgaaagaagtttgaaagggaattaggcttacacctagtccctaattaattttggtggttgaaattgcccaacacaaataattggactaactagtttgcccaagtgtatagattgtacaggtgtaaaaggttcacactcagccaataaaaagatcaagttttggattcaacaaaggagcaaagaggcaaccgaaggcacctctggtctggaggcaccggactgtccggtgtacaccggacagtgtccggtgcaccaccggacagtgtccggtgcaccagaggactccaactcgaactcgccaccttcgggaatttctcaggccagcgcgctataattcaccggactgtccggtgtacaccggacagtgtccggtgctccaaggaagcgcggcctcaggaactcgccagcctcgggatttcacttcagccgctccgctataattcaccggactgtccggtgtgcaccggactgtccggtgtaccagcggagcaacggctatttcggcgccaacggctacctgcgacgcatttaatgcgcgctctgcgcgcgcagaaggcaggcgcgcccatactggcgcaccggacaatgaacaggagttgtccggtgtgcaccggacatccaggcgggcccagaagtcagaagctccaacggtcagaatccaacggcagtg

SEQ ID NO: 13503 - DNA, 1500 bp, Zea mays
agtttttatctataattaattttataactaaaatatatttaatgttaaatccaaaacacgggataaattttagtaatggaagccaaacaacacctacgcgagattttatccctacaaatcaaaaatcatttttcttaactgaacaaaggccaatgaatgtcgtggccgctggtgtcacatgctacctcaccggctgctacagctcacgccgttagcacgttgctgctgcagcaactgttgctgcggttactgtttgccttggtgtcctcaaccagataagggcttacctgttagactatctgcatcgcatccctctctcatatgactgtagcatgtacagaggctacaaacttcctctaaaggctcaacgcatcctacttcgagcgcctctacctgggattatttgtctctcttcccaagatgtggagtgacgctacgacactggcgtgatcacttctctctccaaccacctccattcgtgcgcgctggagaaggatcttgctgaagtttccgtgcagtgcttgcttcatgtgccggtggtacgacctgtgagatccgtggaacaaacaacttattttcgttgtgaacgattatttgtattgccattttcccaccatgattacaaagaaagctggcaactgtaatgtctaacaaagacataaagctgctaaaagtattttaaacacctttggtatagtaaatgttccattttgtaaaagttaatctatggaaattagagacttggtatattcaatgttctatcttctttaaacgaaaaacaaattggctcaaagtgagacatcagtggatattacgttagatgtgtaatatagttatttttgtaattttgaaatgcaggaattatgtagttaatttcatgtgcgaaaattatgtgtaactaatgtgttttaattttttgtacaaattagaatgtttatggacaaggcagtatgcgatttgttatgaaaaataaagaatggaaaataaaatgactggtagttgagttagttgaaaaaaatgtatattttattgggatggtgaggtttagacgagaaatataggttgaaccgctgcagaagatgaaagtatagacgaagaaatcttcactgtagcactataggatatatgagaacgaatttagggaaaaacctcacccaccagcacttactgtttgcctctgctggtgcgttgctgctgcagcagccgcagcgctgctgcaacaatcaggcattcactagggcgcaaccagatcacgcacaggctggtcgctcgaccacccccacgctttgctctctcgctgcctgccccctcccaggacccaggtccagcgagcgggcctctgctccttccgcccgctgaatctagggagcgcgagctcttcttaaacgggcgcacgccgcgtgcgcgcccgacccgcttgccccgcgctcggacgcgtcccgatgcgcctccgccggccggaaaaaccctactagtcctagggctcgcctcgccgccctg

SEQ ID NO: 13504 - DNA, 472 bp, Zea mays
tagttgttgcttaataaaataatgttggttggttttgttcttcctttaaattgaatgaccactttcatgctattgttatttctcaccggtgctagttttccagagattagttgttactgcttcatctttgcattttaagtgaaatcccggtataatcggtgcatttcgtatggggaaattgctggtccatggttgttgggtgttggcaatttaaaccatgtggctggccattagtgttaagtttctccctacggtgtaatttttagaaaggtcagggggggccttgccagcatcatccctgccgtctgccgaaacggcgaaaaaaaaaacaagagtgcgagcccaccacctctccttctctctctgtctctcctcctggctcactctgtgcgctcctcggcgcgtgcccacgtctcccacgcctccctccctgcattccccccttcagatccggtctgccccgccgccgccg

SEQ ID NO: 13505 - DNA, 1332 bp, Zea mays
actactacgtggcaacaagcaaggagaagatggaactgctccggtggttgaagagtgaagatgaaaccatttcagtagaataagaagccacacagcaggtaatatgggtgattccaatacaaatgagttctaagttaaaggccatattgttgggtgggtcgatgatgatgagctagcagtgacgcctaagaaaaatgaaaagccaagtgcaagtacctttgttggttaagtttatacctacagttgcagctcctattctgtaaaattgaagcttgcttttgggttttaacctatctagtgtctgtagtttgatttctgaaagaaaaacggaatacatgtggtccaacaagactgtcaaatgaatagagcaatttgccgatggtctacctgtgtaatttcagtaggttacttctgttaacttttttttggaccgggatactgctgttaaattgatgtagccaacttgtgccaacccacaacgaaataagtttctgtgttgcctcttctctgggaaattttttaatttttcataactggattgagggatttggtgcaaatatgcacctgataacatgttttctattactattctgtattctgtatctatccacaacaagtcatactaatcattaattggcgcgcccaaatctatgaactctctctcgacttgtagacgccctgcccatgtaaccacggttactccctgaactatgaacgaatctaacggctgatggtctgtttagatagctcagcgctcttggaaattgatgatctgaatatcctactgcattatcaaattatcatttcttcatgataatattgctgtcagcggtgtatcttttaaattctcccccgttggtttttttttttttgcaatgccaaatatgttcattttggatttccatggagttgctacgtgcgtgctagagtagtttgctcttgtaaatttggacttccagtgtcaaaagggcctgcaacggttggagtaagcggggcgagggttcagatttgagaagagcctcagccctctcagcacatgaacgtcaatccaaaagtcgcatatgcaaggggaagctgccagtgccagccggacaggcatgagggtgtgtgcttacgacctcactgccaagcggggcccacctgcagatccaaccctccccgcaacggctagttccggcccccgcagccgttgggacaaaaggcaaacaaaaccagagtccagagggagcggagctctcccaccaaaccaccgttctaaacgctcccctagtcccctgctcagcttctccagagatcgccaaagaagcagcatcggcagtaagctctgcggcg

SEQ ID NO: 13506 - DNA, 1500 bp, Zea mays
agtcttcatgccctatcttgtgtacaccgtcgtgacactaccaggcactagatacgaatcaagcacgtgccaagcaaaacaacccacaaccgaccccaacatttaaacaagttcactagaatattcgccgagtaagccatataacgagagctactgattgtcaaatactttaattagacctactagttgctaggaggtataaatagactcataatattgtttgtgtatcatgtatgtttttttgggtcatcaattttgaaccaacaacctttatatcttacatctacattattcactatttcgaacactactttataaatattatcgtttacaatgcaaaatattattttaattacacgaccatatcaactagtgtgaaatatatcgtcattgattggtaccggctacagtgtcaccacatcgggcccaagtgtgtgcagcaaatcgtgtacataatgtgtaaaaaattatatcggtaggttgtattgtttattgaataaagttttaaaaggtgtgacatagaatctgatgaaagcatcattaccgtggtactacatctgttaaaaaacatacgacgccgtcttattaaaaatcatgctttatcgtttattttatgatttgttttataatttaaggttaattgagtgtggctaaaaaattatactctgaataaatatttataataataggaatgattaaagttttgaaaaaacaacgcctcgaactgagagattagcatcataggctcgtagcaacggccaggaggctcctggcccatcggcagcgctgccgctctccatttcaaaatttgaaaatatcagcgcggcaggcggcaccgacgaaccacccgtccaaatcgacaaacgcgcggccgtctcacctcactcacctataaacgggtcccaccgtacgtctggcccacagggaggtccggtggtgctgtcctcccgcaccgaacgtgaggtgaacagaccacctactggtatttttagacctacacaccttgggagtacacatttgtgacacgcataaaactagagtacaaaaaaagtgtgtggggtccatggaacagaggcagcggtgggttgtggttgtggcaaactcaggtaccaacaaaaagtagatcagtacatgccagctccaacctccaacctccaagcctacaaccagatcagccggtctggtactgtgcttctgtggcacgaaaaaaccgaccgttgcacggacgagaaacccgaaccgtcgaaacaatcgtaatccccaggggctcaaacgcaaaacaccgtccgctcccctcgctttcgcttcgccggcactccatccgtccatcgtggcccaggctgtcgttccgttctataaagggcgtcgagaggaaaccggtggaaccctacactgagaaccgcagagacaggcgtcttcgtactcgcctatctccgcgactcaaagcttcttccatttcctaccgccgccgctgcagctccaccccattccgtcgacacc

SEQ ID NO: 13507 - DNA, 484 bp, Zea mays
tgcagaagaatacataggaaaaacggtagacaagtattctagtgtaatgctggaggctgttgaaaagatggttgaagagaaaattcagagtgaagacgatatgcccattatctgggaaccatcccttgttcatgaagtgagtcgtcttgaggtgtctgatgtgtcttgtgggcttgaccattccttgattctctgctgtgagtatttctttctactacaaacggaactccttgcgtgtcatttgtgatggataatgcttttcttattcttttatgctgagcacgtggtaaccagagtcaataaaactatgctgtaatgttgcttcaataatatttgatgtgatcaaacattggaaatatcttgtactgcggatgcaaatagtacatgttttagataatatttggttatttacctgtcattatcacatcttgacaaatcttacttggtcctattacagttcattgtatggacaatttaacataca

SEQ ID NO: 13508 - DNA, 817 bp, Zea mays
cccccaacttctcttctttgcaaccgggtatcacacctgcataccacctgccgtagcaacccgagacctcctgcaaacaacgcaccacaactccgtggtaacccacatctccgacgagtaattctgggggctccggtgatctactctctatagctataggtgctactcgatgtggacgaaacaacgaactcgaactcagttgaagtctatttagcaatgtatgaagtgacgacgacgccgaccactgcacacggtggcctgctgtggcaaatagatctggtgaacaattagccccaccccgtgattcccctttgatgaatcgaaggccgcagaaggtccaacaagagatggagagtacctcggactgctctctggagatggtgcgatgctgttgttgtgattcaccgccgacagcttctctccctctttgtatctggcgtagaggttggtggtgagtggctcacggtggcgtactcgcatcttcctcaggtcgaatgcctttatttatggtcataaagggraaggtccaggcgggcgtggatcctgcatccgttgctgctcagtttgcgccaagcgcggatctcgcatccctccttgttgttcggtttgcgccaggcgcggatctcgcatcccttgttgttcggtttgcgccaggcgcgaatcccgcagcccttgttgttcggtttgcgccaggcgcggatctcgcatccattgctgttgggatagggagggaaggggataaccatagctgttgggagtactaacttgaattaactctatttgtttctcttgtgaccaagttcaggaattgttcaca

SEQ ID NO: 13509 - DNA, 901 bp, Zea mays
ctcctcccattcataaatatatgataccgttgacttttaaaaaaactttaatcactcattttattaaaaaaataataagttatcatttagttttgttgtgatttgttttatcacttaatatagtttgtgtttaacttaaaattttatatttttgaataaatattttgaataagacgaatgattaaaatttttaaaaagttaatggcgttctatatttatgaacggagtaggtagtaataatctttgcaccatgagacactctagtgttatccgctagtatgattatttgctggtttacttggtctgggtgctcgacaaattctggagctccaaataggaataaaacctttttggtaccggaacgggcgtgaggctgcgctgaaacctctcgctaaacgctgtttgtaatgcagggcctccgctgcaaggcagacgcattcggctcctcgtttctctctcctctcttcgttcccgcgcggagagggagagggagaaacaggggagcggcggccccctcctcttccctgccacggtttcttgcggattatttctaccctattttattcaggatttccggttggatcctcctatggtaagtgcatcataatccgtcacttttatcgcatttttttttttgttgtcgatgatagatctgactgttgtggcagttctgatcttgtttttctatcaatgccgcaaagaggaatattgaccagcgtggaattaatcagccattcacgttgctgcagcctttttgcaggggaaattttaacttctgctgcaaccggtggtgcaattaatcagccattcacgcattgtgctgttcattgaggcattatcggtgtggttcattgagaaagcgcctgtatgcgaattttcatgtaaaaagagctgatcagac

SEQ ID NO: 13510 - DNA, 1321 bp, Zea mays
ctgaaacacagcggaccttttttcctctaatatattgtggtgatcgcaccataaacacaattggtgcgatctcgtaagacttaccactccggtttgatataaatacaatggtgcatgcaagcaacaaggtttaagggtgtatatcatcacttctaatcacaagacaaaacctagggcaagtactaataaagcggtctaaattatttggatctgtggtagcaccaaaaataaatttataaacgcagataacacaaccataaaagtatagggaccagaatatgcatgttaagaatttagaaactggaacgaatacatcttcccaagtttagatatctatatgtgcactttatgagtttagggcccaggatgatacaacgctacaagtttagggaccgcttatatattttactcttgctttgtagcaactctaactagatgctcggatattaggccgaatttgttgtcatgagctttttagatgttgccctacataacaagtggatttttgatatgtttttatcaaagcgcagagatgtgcatctctatgtgtgtgttttttattttctaccaactattactagatgtttcaataattgattgcttttgttgcaatggcttctatggatggtattgttttgttttgaccgagatggaggtgtagatcgagaaatgttctctatgttgccatagcttgtttttggatggtgcaatatgtgatttagtttgtttcaatcattcctatactacgttgcagcaaggtgcttcataaggttatttcaggtattagatcgtggccaacagatatataatcatgtaaaatactattttatattatagattgtactatttataaagtacataaggtagaatttaaaataaaaagcgagacaaaaagttagctggaaatggcctttataataaatatatttacacattgcggtatgtctgcgcatatgtggtagccgacagccgtacatgaattgattgatcatcagttatggcctatgggacccagattaccaggactccgggatccagcgtttccgaaaacagtacgagatgggcacggagctgtgaacttgggctaatccgaggtagagattttcgcaatcgtcaatccgatgacggttggtagacagtctagtgaactgagaccacacaagttggtagacagtctagtgaactgagaccacacaaacaaggcacggagctgtcggcatgaatcacgttctagtgttctacagttcgtcatagttcccgtgatggtcgactgattgacactgccaacctcccaacttcccaaatatatcgtcgtcggtca

SEQ ID NO: 13511 - DNA, 222 bp, Zea mays
ggtacgccatatacgcttataatccgatcgattcgatcgacacatctcactaccacagaaacgctagctagctagaggttgctttgttttttttttctattgcttgtatctctttgaacaatttctccagaatcccgagcaatcgccaagtacgtgctccgcaaatactccaagtcagctcaagtcgacctgctccgtgagggcaacccggaggaagccgcc

SEQ ID NO: 13512 - DNA, 1500 bp, Zea mays
tgacaggtcttagttaaataccgagtccatgtgtagtgagcttcgatggacattagttaaatgagccgtgccaggtcaccgcatgggcttgacttgaggcgtaggcatgacctacatattaggtcgtgccggccaggcccacaattaggttaggatgtgcctagaattgtgtgctttgtgtcgatctatttagcacaacacaaatgtacacctatatatgcaggtataatctatttaattatctgtcatcatgtttttaggtggacggaaataatataattaagacattaattatgtctcttagaaggtcccatctaaaaagttagatgaatctctattttattcatacatttcataaataaactatagcatgactttttcatttcttacattatattttatgagtattttttctttcaaatttaatacttgttgttcatgttaacttaatatttaaaataaagaattacggtgtaacttagtacaacaataaactatatcgaaaaattaaaactgttactggattgctgctaccaaatgatacgtacggcagtatataaatttaaaactgttaccaaatgatacggcagtatataaattttgtgaacggcatacttctaatactgaattctagatccatcactgcgcggtatagtgcgagtgcctttacgacgggacaaaatcaacgcatccgtagctagtacgttgttgaatggatccgtgccaccacctctgctcggcgagccgtgtatacgtaccggtgcaactagcaccaccccgcgtacacgtgtacgtcgtacagtaccccgcgcgttgtcagaagcaaggaagcaaagcacggtagtactcctcctaccaccacgccgtcacgtgatgtgtacgccactggactggtgccggccggccggcctgccgccgggcacgtacgtgtaccggcgctacaacactgttcttggatctcgatgccatcctttaattagtctctagtatatattgtgtcgcacgacgaaattaccaccgcatcgatctgcatgcatttaccaccggcgtcgcgtctgccggtcctctcgcaccgcggatcacgaggttgatcgggcgccgagtaaatgccggtgccccattccatgtagtacacggcgccacggcggggcaggcggccacggccacatctgccggttccaaagaggttgtcgaagcgccgaagaatttgccgcgtgtcggctccaacgatgagaccaagccgctgctgtggcaccaccccactccatcctcagggctggtggctggtttgacggttttcctttcccccagttttcccgccctcgcgcggcttcaaaaaaattgtgccggccccgcagcccctgcaccaggcccgtcgtctcctcggctctatacaaacggaacggacggacggacacattgtcgcggcgcagacctgggagaggagcaggagcggccagtcagcggagcggataggaggcaggaggagtcgcgccggag

SEQ ID NO: 13513 - DNA, 447 bp, Zea mays
cgggccattgggattgtttttggagaaaacgaaaaggtatctcacgcaataaggcccggccactcaacagtccctggaaaatggacgctgcgagcccagtcagccaggtccagcccaatccatctacaccgacccgaccgttagaggggaccaggcgtccaggctcactgtcccaggcactccgccgttctccactccaaaatttcaaaattcaaattcgctctccgctcctccgttgacgggacgccgtattttcccctccctcccgtcgcgcacttgcttgcctgccgttactactactggtagtataaagcaaaggcaaaggcaaaggcaaacccctccccacaaaccctaacactccaccgacgcccagatctgttccttctctcttccacgccgccgccgccctcgaattttcgaatcctcagcaacaatcgtcctgccgcc

SEQ ID NO: 13514 - DNA, 643 bp, Zea mays
cgggccattgggattgtttttggagaaaacgaaaaggtatctcacgcaataaggcccggccactcaacagtccctggaaaatggacgctgcgagcccagtcagccaggtccagcccaatccatctacaccgacccgaccgttagaggggaccaggcgtccaggctcactgtcccaggcactccgccgttctccactccaaaatttcaaaattcaaattcgctctccgctcctccgttgacgggacgccgtattttcccctccctcccgtcgcgcacttgcttgcctgccgttactactactggtagtataaagcaaaggcaaaggcaaaggcaaacccctccccacaaaccctaacactccaccgacgcccagatctgttccttctctcttccacgccgccgccgccctcgaattttcgaatcctcagcaacaatcgtcctgccgccatgagggagatcctccacatccagggcggccagtgcggcaaccagatcggtgccaagttctgggaaggtggtgtgcgcggagcacggcatcgacgccaccggccgctacggcggcgactccgacctgcagcttgagcgcgtcaacgtctactacaacgaggcctcgtgcggccgcttcgtgccccgcgccgtgctc

SEQ ID NO: 13515 - DNA, 187 bp, Zea mays
aacaacacatcttgctggaacgcagaagatagaacatacaggaagaaaatatgtattcgtgccccgactccatatgaccatatataagtaaacactgtttgatgtaaatcaaagattcagctgtctatgggagctgttctagtgtctggtcacccatacctgcgaggaaacagatgttgcgtgctta

SEQ ID NO: 13516 - DNA, 399 bp, Zea mays
gcgcccgccgcgccgggcgcacccggaggaccttgacccgcacgcgcacagccgccggggtccaagccgccggcgcagcgccgcccgcggaccgcctggattcccgccgcgcccgcttcggcggggcccgccgagggctacgacgacgacgaggagcgctactacgacgacgaggaccagtccgactccgcggccgccgccgccgcgagggctagggtttcgggcagccgcgacgccagcggcgacgagtcggacggggtggcggactggggcctccccaacggtcgccttccctccgcgacggggtatggcggcgtcaaggcctggctcgatgggttggggctttctcggtacgcgcccgtctttgagatccatgaggtggacgacgaggtgctcccc

SEQ ID NO: 13517 - DNA, 601 bp, Zea mays
agattatgataatgtgaccttcagattatataatctgacactttaatctgcttgtttgttttctagctatctagatcatttaagctgtattatataatttagacaacctcaaacaaacgagcccttggtggtaaagataaaattctgaacattttagtgacgcgaatataaaaggctaaaaatgaaagcatcgttcgtatggccaatctattggtgactgtatacaatgcagttccacagtttgccgacaaagccggccggtgcttagctactaaagtcaaagaaatgtcattttcttgacaagatggataagtggccaaacaccgtgacactcacaacgaaatggaacgtcgaatctggtaaatcacactgtaccatgcatcattagcaagacgacaacgcgatcggccgccggcaattcggagcgatagcgtgcacgcgctgctcaccccatcacatgacagcaacgactttcgggatcatcgccatggccatggccttaaataacccttaaacttactgcagagaatccggccgggcgtggcttgatctggattggagccaggggcattcgccgcctgcggaagccacgaagacggag

SEQ ID NO: 13518 - DNA, 640 bp, Zea mays
ggttagagcacaatgttctttagcccgcctagtccagggcctcctttgatgattgcgccgtgtcacctagtttatttgtaatcacaaccgagtgagcttagggggcgtttggctcagtaatcaccagttaccgtccaagctttgtattgttaaactctatttttgcttaatgaaaatgtgtttccgcacgatggcgaaaaagattgtactgcacatacacaaaaaatctagtgttgacctgtaaggaccagggataagcatgggctttcaaattacatgaacttattgcatatttctggtatgttaataaatattagggatataatcatatcaatttgagtaatctaattcatgaaaatctacagtaacagcttggtttttttaatgggacgatgtgttggatattcgtgcggagcctacaactacaaaatgttgttttccctcgaacacataggagagttgctcaatattgtataaataagtaaaatggtggagagcttacaaccaatcacaatttgataattattattcactgaatgatgaagtagacattttggaagttctatttgtgcagatgctatttttccttaactaatgtcacatctcttatcataaaatatgcagtcattcacaaaaaaac

SEQ ID NO: 13519 - DNA, 431 bp, Zea mays
ttaaagttgtttaaaaaaactatggtgttgaagctttatatatataacccatttttttaataaaatcaatgcttcaaaaaatagaggtttattttttttagaaactctaaagatttactgtgtctaaaactgtaaataaccagcattttacaaagcagtaatacgagtatttgtctaatactcctaaaacatgttcggcccattgtcgatcccgctcggcccagctcaccaccgctgcacgcacggccagaatcaccccgagcccgacccagacgggttcctctcctcaccagcatcatatcttcctccctcgcctattccccttccccgcgtgccgcgtcaaacaaatctaggcttccaagcgagcgaaagccttcctccgccagccgatctaccaacatcctctccgccgattggaggcacctgcgaag

SEQ ID NO: 13520 - DNA, 416 bp, Zea mays
gaaaactagatctggaactgacatccccccccccccccccaccatatagaagatttagttcatgaaattatttataatcacgaggaaatatcgattcgatatgctataaatatggatgcatttagtactcagtaggcgattcagtgattgatgtgtgtaagacggtttttggaaccccatatattgttgggttctatgtggtccgcgcaggagttcagtgacatttcggatctgaacagcagtgacaatgtgagcttgctttctggctcagtggtaaatgcctatacatccatgatctaatcaacctgagggagggtactgacagtagtaggcgtttttttagtattttaagtttgagtgcttgctgcagtatctaaaactaattcctatgcgcttcccttgtttctagggcgaaa

SEQ ID NO: 13521 - DNA, 1124 bp, Zea mays
catatttattttgaagttatatacataatgttactttacaaagttaattttcagtacttgagatattccttggatcttttttggcttaagacatccttaaggtggatcaacgcataagcacaacttttagctcctattctcacacaccaggaatgtactaagagggtgtttggatacctaaactaaactttagtcatggttttggatgtcaattagaagaagtaaatatgaactattcatgaactaatatagaatgaatgatggttaaaactcattatatttttcaccaatccatatttaatctattgtcccaccatatattagactttagttaaatgatccaaacacatcttaagtccaagttaaaattaaaattttaaaattatcacacatctataacttaaattagaggtcatcaaaggtctatcgaaaaagaagatagaatgtttatgaacaaaatatcaatttacttagtcatccatatgtgtaatgatcgttaagagtacaaaatatagaagatgtttgatttctttagtcaaccttctaaattttaggaagcgaaatttagtctttagaaattctatttgaaagacctattttagtcactagtttattattttagtgactaagctttagtcactaaagtttatgaagtggaaaccaaataccctaataatcttgcctattagtttatgattcttatcacatacatggagagagcaatacaagttttatgcacacacaacgacacaatgatcgaaacgagtgcttccgtatcaatgagtcattgagcatgtggaagcaaggctcaaccatttccaaggggaaaaaaaagacgaaggctcaacacaccgattcctgtgtacacttcgcgtgtagcggtagcgtcgggcgccctcaccgcggtgatatctaaaaatcgcacccgcaggccgcaccgcagtcgtcaccaaacagcgccgcgctccgcattgcgctagggttttagaactcttcctccggtcctccccgttatccctccaaaaggcagcgcccgctagggttttagccgccgcctccttccctctcctcctccacgtctcctcaacagccgctgccacccggagccttcccgcagcgacgcc

SEQ ID NO: 13522 - DNA, 217 bp, Zea mays
cgtttccatgtaaaaaaacttcacttattgaagggtaaattctaaaaggagcgaggggcaaattctgaaaaatctgggctgtccrctagtccactcttctggtcctctcgcttttgcgctcccttggtcgtcttcgtcccctgctcgtctcccgtccgttttcggatgcccactccgaccaaaaccctagctacttcgtgaaggtggaggggaggag

SEQ ID NO: 13523 - DNA, 171 bp, Zea mays
agtgagtgaggcccaaaggcagcagcacgtacagagcaagcgaagggagaactcaagcgagggaggcagagggcgaagctaagcaagcagctagctgctcactgcttgctctgtgctggtcgtttgctctgtgctggtcgcgttccgtttgcaggaactccttgcctggtg

SEQ ID NO: 13524 - DNA, 217 bp, Zea mays
tgttgcctcgttcgctcactaggtgttcaggacagagttagaagtcggtgatggtaggactcctcgcagctagcttagcttttgcacccttggggtactaggctagttagagttgagtcttttgggccgttgattgtaatcgtgataaactcttttggcagcatggttgatggatgatgttagttttaaatttggaaggaaagtttacgacttttga

SEQ ID NO: 13525 - DNA, 943 bp, Zea mays
cctggagccggtgtttggcggtaatatcgaggaagtgatgtattatagtgaaagagtaggaggataaaatattactttaagaccacaaataagctaaagtaaattagcattggttaccttattttaacttatttatgataataaaataatattttactctcgtactttctatcataatccagtttatataatttagaagaagaacaaacgtgaccttgacatcaccatgaactgaattatgcaaggagcctcacattccgaggcggtcctgctgttgagtgtgtagcgtagtatccatcactcaaattgattcaccgtagtcttaactcttaagggattgctagagaacaggcgaactgcaacaaactgaacaatgcttgtcttgtttcctgtttctttcgtgtacgtcccttttcatttggtccgactgacgcccacagtccgcattaccatacaaacaaatgattgtaaaaaggccaaaatactctcgaaaagggactttcgaaaacaaaacaacaacaacaaaagcatataaaacaaaatgcttttggagaagaagctttcacgaaagacggccggacgtcgagaaacatgacaaatagtttcagaaaaggaggacgattctccaccgttgaaatgcgggggaaggatacaaaccgaccgaacggtacatgaaccacgcggcccccacgggccagcgggctctgacgtgggtccaccgaccagtagcacaacacatgcactggccaccgtcggaccgaggcacggacacttcacgcaccttgcagttgcagcggcggtggcacggcaacagggaggagagaagagtgaggaactgaggatagagatattttaagcgcccctcgatttccttcgccttgtcaactagccctcgctcatcgcatcgcacgcatcgcacagacactccactgcacgcgcagca

SEQ ID NO: 13526 - DNA, 83 bp, Zea mays
ggtgacgatgtggctgatatgttgtgatgtttcggtgagtgtgcagggccggcgagctgacgcctgaagagctggagcgcctg

SEQ ID NO: 13527 - DNA, 493 bp, Zea mays
agacgagcacgagcaggagcaggagctttgtcgtttgatcttttacacttgtgtaacattcattgtctggctgtcgtataagctttttggggtcctcttttttttttaaaaaacattatttgttcccacgatcccattggattcgttataccgtacgtaaatgatgattcaataaagggtgtgcagtacgtacttacgatattgtacatacggtgcagaaatgttttcagtattcatatatgtataaggaaccgatgacggcggagatccggcgagctgtgtacagacccaaaggctctcctcatctgaagcatccgtggctttccttggagatgtaacctgccttttctgtttttaatcaatcatctctgtactctgttctgcctgcgtcgctttcggctgcatcgctagcactagcagcggggtggggtgggggtcgtagtcgtgctaagcaagcagcgatccgcaccagaatccatccaatcgcgcggcc

SEQ ID NO: 13528 - DNA, 155 bp, Zea mays
tttttaaaaaaataatctcattctttcccttctgcctgtgcaattattttggatgacatatcatctgcaattctatgttgttaacagattatttcttgtggttttgtacaccttaacaagcatgtaccaggcatgagctgcagatcttgcttaga

SEQ ID NO: 13529 - DNA, 975 bp, Zea mays
ggatttcagccataaatatctactgttgtactagatgtagtttgtgaatgctcttaagcaaatatttccaacgtttgtgaagactacagctttctatatcacttgtactgtagaccagaattcaatttctgggggaatatagttcaaccttgagacaagtggtctctgtcgcttatggtagctaaaaagacattgtactaaactttcagtgagttgagctgaataaaatgaaacatgatggtctggtatcgcagctagctgttacaaggtagtacattcagataatctaaaaaaaccaacgtttgctgctgtcagtcagttgaatcacacgagtataggctgtatatagtgaatgctacagtggatcaaaactcagcatcatttgtcatgttcgttcttgcaacgttatacagtttatatgggtttcattaattaattatattatctagagttgagcgcagcacatgttttttcagcttttgttttaatttctacatgtgtactgttgatgtcagtccagtgctgatctgacattgatgtttcattagctttgccttttgtcactatctgctctttgtttctctggcaggtgcctttgtgggctgtgcgctcaatggaagtgtggtgtccactcgagactcggtaaatgcccggttttacggtggtccgattaaggcctcagaaatccttcttgggtcgctgccaaaaccgcctgctgccgcaactctatacaaggctttatctgtattatttgataagatcgagaagtgaatctcctgatccttctctttagtttgcgacacgcagggtagcatggtgaattgaattatttatgggtcattggttcgctctatttaccttatcctagttggtgatgatgcaagtgtacacctgacgatccactgttttccatcaaactgaggtatttggaaccacaaaccactctgtaaattttgtagacaattctcgttagaa

SEQ ID NO: 13530 - DNA, 999 bp, Zea mays
aggtattgttataagccgtcgcaacgcacgggcaaccgactagtctgtgttaaaatattagtcgtcgtagcagttaaattttattatgtatatgttcaaccagatgtcaataaatctagatatatatataaaacacatatattaaatatggtataaatctatcaaaatactaaaataactaatatttagtaatatttatttggtaatagcgaagctcgttgggtccttctcttcccctggacagcagacagctgagccagagctgccctggcattctggccctgccttgccatccgagtgaacaaaaccaaaaaattattatttgtcctcttgctgaccacccccccccccmccaacccctcccccggttttccttttccttctgaacttaacaatacagtggtagataaaataaaattagctccgacacttgctgcagcagttacatgtatcacaaagcccaccagtgacacaccccactggagccctcttgtgcttttgctttgcgtgcgcagagctcagcattcagcaagactcgctgcaacagttctcgagcaatgcattttttttcctcagataacttttttgctttaaatttttttctaccaagatttctctttgtgaattgacagtggtgtgcccctcccctgccacttcctatatatctgccctctatcgcaactccgttgctctgtagcggttacctccctttcgctctactgctctctctctctctctggaccttgccgttctctccctcgtcggcaatcagcccgcttcctgtgctctctatgctccccttccgttcgtagcctcggccttcgtctccctccatggacccgcgctaaatgcatcgcgagattccaaaccggtagcgtttcttcctgctccatccgccgcaagatgtaagcaagggcctcacttcacacccggagtgggagaccatccagaatacatcctcagatcttcttgtgtctgagaaaaaagcgacgcccttca

SEQ ID NO: 13531 - DNA, 946 bp, Zea mays
gctcggtacccctgatggcccgccccggaagcaacaccttccttcctctttccctcacgcaagcgcggcctgcgcctgcctacgtgccgctcccgctcccgctccgctttacccgacccgcccggggggccggggatcctctgcggccgtggtggccggccggcgtcaacgtccgctagtacacgcacgagtcgtgaaggccatcacgctacgctacgctacgcattgctcggtgacgttcttctcggcgactaactgcgagtcgtccacgaaagccacgtacttgctcgtggtacggttagttaccggcttcatttaagctaagcaccggcttcatcagcagtggtactatacgctgtatgtgcgcgctatccctctcattgctaggtcagtcgcacctactatctctctgctctcgcatacatatgtgctgcatgctgacgtaccatgacaccaccatagtccatagccatggccggccggcggtccctcgaccgtattcgtacggggtacgtacgtgcctacttctacctacgtacgcgcgcccagctgggccagtgtcgtcgtcgcagcgacggaagaggagcacgggggatagctaggctaggggccggaaaagacgcgtgatgcagcacatcaagcacgcgtacgacgccgcgcagtcgcgggtccgtcgtggtctcgctagctctcgcgtcctagcagccacagcccacaggtggcacggacacggtaataaagcgacgactgcgacgatccgtccaggtccaggtccaggtccaggtccggtacccatccatccgtcgcgggccggccgatccctttggcttttaatgcagcctttttgtcccttaaaaagcaaccaccagccgctcgatcccgccttggatcgatcggtcacgcttcctttccttgctcagctagcttgtgctcctaaagctttgtc

SEQ ID NO: 13532 - DNA, 1056 bp, Zea mays
gtaacaaagatgtctttcatgaaccttaataattgacaatttgtaattctggaaagtgaggtcgaaacttagatatctcctataaggagttgcaactatggaacctgaataccttgatgattcgaaaaggttcaaatttcgcaactggatagcggtcgcctcgtcaatcgtcatcgaagaatttgcttaagaggaaaggctttctgaatgctgctagtaagttacactgtgtactatgtggttctaactgcgaagagacaatcttccaccccttcaccttgaattttgaaataggagatgaggatgagattgccttatgaatcacattatgcgaagagacacccatttggaagccttttgatcatatgcaacactatcctccatcgtgtatatatttctataaacacataccaataaaaaataacagtttatattatatcatttggggcatatataatctattagattttgaagtataagagacaactaaaagacttcatgatataactttaggtctttagaagtttggatcataaatacaattaagatgtaatatgtacaaagagacagactctttataaaaaccataattttttttgtttttttccaattaatctgtagagaatcctcaaatggtccgaattaaatatatagggttgtacataatatccccaaatcctttatttacactaaagacacgagacactactttaaacacagatatcagataagttgtggctgtgattgattcggggaccaccaaccaccagcgtcagcgcccatgttttgccaccgtcacatatagttttaggcctagtttaagaacttcattttctcaaatgatttacattttctaaagttaaattagttcatttttccttgagaaaatggagtttctaaactagttcttatctttttttcccagttttatccttagagggcagatgctgctgcagctcaagatagccacacacacagacagtgacacacttaagagctcgagatctcactctcctcacctcagctctcagagaggaaggacactgcggccgggcg

SEQ ID NO: 13533 - DNA, 1240 bp, Zea mays
ccgcgcctggcgggcgggagagtgcgcttcaggcggcttcagtccagtccagtccactcccgccaagacgcaaaaggtgccattttttcttcttcttccgcttcacttcaatattttcagtctaggggacgggaagcgacgcagcctgtgcttctccctcactgctcgcccctctcccttccggccgttccggtaaattctctccatcttggtcaccgtagttgctctacaatccttcagtttcggagtaatgttctgtccacccgggcttcagattcagagaggctagcaaacgtgcagtctggttgcgatttgaggccggctcatgtcgtcagtttaatccggttgtgattctcagccgtttcctgccgctacttggtccagccgtccaggtacagttgggaatccatgtcaggctttgtgaatttcgggagtagggagggtggagtggtggaccggagtaccggaccggctggtgttaggtttaggatcttgtcccaatccaatctggtagcaccagtcagccttcacttctgtgcctgcctgcctagtttcaaggagatcagtcaatcaatggtctctaacctgtaaccaccaccacccctcctttactcctccttccttcccgctgcactgcatcctggtaaaagctagtgctcgtgagcaactgctcgtctttgagactttcttcaacacgaaccatgtgaaattccagcaatcatggatagggtagctcaggcggctactgaatgcacagatgttccgtggaagccagttccccaaccgcttcctgtcctgcccttgcctgcttatttgttcagcggtctcgctatccaagcatcaaaatttgttcttataccaactggcttcttggcgcttgcccccctcctctgaaattgtatcattttcttctttagaacaagaattgtctagtcttaacttctccctctgatacgaactagggttagataaggtttcctgttactttgcagtttcctcttgacttggtgtgctttcccgagtcttcagtcatctcctgcctgaagcaaactggcttctaaaaataaattgtcttgtctgaagataatgtaattttctacttctaagttctacctcctttaattgaccagcatatcatttctttaattccgttctccgtttcctcacatggaatatacaccatctgactgtttcagcctgtctgttcctccaccttctggttgctccagaaaacacagcg

SEQ ID NO: 13534 - DNA, 1369 bp, Zea mays
ctctatagaccaggagggaggcgtttacatatggcttcttccggaagggagtgtatcttgagataaaaaagaagggttcaccatagtaaaaaccttgttgtgcgtcggtatctttccctgtgtgagccttcttccgtatctctgagattgttgggggaggacgtgatccgtgctggcgatgaaaacccgggcaccatcattgttgttttttgtccatttcacccctatgccgactttttccttcgtagcctttctacgggttttctctcttgtcttcgtgcagggcagtagggtgtcgggagacttaggcttagggtatgtaggtcataagtgagaagaagatcaattccacacgcgtcgtatcacgccgactgacgtattaatgcggcgtgagcaaagatgacggtgcggccagtctggcggttacgtgagatccactcgagtgggttccaatcgattcgtctgaccccttatatcctcctctgtcgcgtccaaccccctggatcgtcgcgggagagggggtcatgaagcccaacaaacgtagtacattaatcaaggggacaaagtctataattatattttcatctcttattcatgaaaagcttcatggcttctatctccaagttgaagctcactaaattatctctggtcttctcaggctgcaataacgcccaaaaccttagctagtatgttcctatggaaatagcctataaaaaagagttatattttgtattgttaaagcaaatattgtttggacatcgccaaaacaactagcataaagctgctgcacttactaaaataatgcgcctttctttttaagaggccatgttcaatcgaggtaggtgttttagtccggtaactatatgaactagcctccaaatatttttagcatggtggcaattaaaaaggatatagttaatggtttcattgctattactgaagcaacaaatctgactaccttttcaaagatgtaaataagtattctatcaacatgtacatttcatagtggcttggggtgtttgattggtagaatgatatggtcgatcatcatctcactgtctagttttgtatttgatttgtgaaatagaatgagttgatctatggccatcttattgctcacaatactaataatcagtaccggtaacaattagtactgccaaattatttgagaaaagaataagtcctcagaccaaacacgccataaatcaactagtttgatgttgatatcttttttaatcagccccattcacccttgatcaccattcaccattgccctgcagctattgcatctataagagctcatgtatctcgccatgggccacaaactaaaagaactagagcagattgataggccagccaggcatccagc

SEQ ID NO: 13535 - DNA, 1500 bp, Zea mays
tcactgtttcgatgaagcttgtcaaagaagtactcttagagttagagaaaactaaccagtagcctagccatggcgcgctcgcccccaaccccagcaacgccacagtgcgctcgccctagctccgaccgaccgaccgcacgctcatcactagaagagagtgaatgacaaagactgatatgtggggccctatttgaagaataaaacagtctgttccaactaaaatgtcattttcatggatctgaagctaactgattccttggttgatccacggtcgatcttggatggactaatggagctgctcaatagtgaaatcttagatccagatcttttcccctcccttcatgcaaatatgtagcacagcacttgttcacatgtcaagataccagtggccgccaacgagtccgtgatcagctgcgccgtcagattcgaccgtctgtgatgcacgcggttgttgagagctttgactacacgggggcagcacgccgacatggcatttcgagcttttgaccatcgtcgtgtgctgtggccatcgcaccattgcagctgcccaaaagaaaaaactgcaggcgaacgggaggcagggagatccgttttctttctttggtgccgatacgcggttgcacacagtctggagcctcctcttcatgtgagatcattagcctgtcctttcaaaacacaggaatcgctgaggaatcaattcacgttggaaacgaaattttcattgggtttttaaaatcacgatgaatgatggatggggcaggatcacatatacacgtggttacgtggagaatctgtacacctagggatgggcacgcagtttgcctcgtttctttctttccacctttgacaggagacgtgcgctgtattcatccatgcagcgaccgagggtcactgcctcgctgcaatgcggccttgctctcctgccagaccagacactcagagagatcagagagtccacactccactgggcgtctgggctccgaagacggcgacaacggagcttcgctcggcgcggacgtcagcgcaccacccttctagaacacaagctttgccttgcccgccatgcgtcctctcagaccaaccaaatctgccgcagtgccatctctgtgccctccttgtgtgtgtgtacaataaacacagcatgggttcagtcaagtgaccacgattcagtgcggaattctccggttctcctcctcacacaagtgacgcacattccaacacagaaatgctgcacactgttcgtcttccgtcctcacgctccttatcgcgtcgtcccgtctcggccactcctcactagaaccccccctcgtcgtccacgcgtcacgtcgtcagcctcgatcttggccgtgcaaactttgcaccggtcgtatcgcggccggtgtgtggagctggcattgttttataagccgcacgtacgcgcgctcgtcatttaagctatcgagagaaagcagagagagagagagagagagagaggcaggctaggttaggaagacgcagcca

SEQ ID NO: 13536 - DNA, 133 bp, Zea mays
agttgcatggcaccatacgattgcccttcttggacgatgataaacacaagtagaccagtgtactttctctatgtttttgtacacataacacatgtagttagtattcataataataacaacaacaacaacaaca

SEQ ID NO: 13537 - DNA, 785 bp, Zea mays
ccttgcatcagtacttccacgacggaagcaggctcagccgacgccagatttcactcccaactactacagcaggacagggtacatacactacacggctcgttgttccctgggcggatgcaatcggacttgtgctttagctgcagcttttgccttacacgctttagatacgtgcacgacaggatcggtaccggaatttttagtaggccttgacgacctagattggcaatttggcccagcctttgcttactcagtacgaattgtactgccctgcaagctgcagtcgttactcgttacagcttgaaactgggcatctttaccagcaataatttggcttctgaagtactatatatatatgctccgttgcttctatcagataacttgttcagttggatttttcttttgctagttgttatgcacacgttttgcactccttacatttttttccagtgccagagcacggttttggttttgcaataccattcctccagagaatatatgtactaataggttcttgattttacccctcgatacactcacccatttaagttgaagtggggggcaaaatagctttcactcctgggataatccttgctttatgacatttttccccttttgaatacctttggatttgagaaacactaacatttcgtttgttcttttgcatgattgccttttatgcttattgtcatataattgttcttccattaatgatggtaaaaatatttttttttttgcatagcaagtatagaactatagattacttgtctctttgaaatctctttgtc

SEQ ID NO: 13538 - DNA, 736 bp, Zea mays
atatgctctaacagtcatccccttggtcgatgaactcccttatatttccagtaaagaaaagacagcagccaacgctaccaaaatcctgccggagatacacttgtttcggccgattgcttgtacccccagtgatgatgcatgatggatcggtgaacgacggcataagcgatcgcccccagcagctcgcacatcacggctcgcatgttcacgcccgctgtctccactccaccgccgaagcgagctgggcctgggcgtgtgcttcacatgcaccgtgtacccgatcaagtcaggtagaggtagtcaccagcttagggctttattcggtatttacaatacacatggaattggatgtgattagaaaaaaaaaataagaagaagtttgaattatttgagattcaaactcatccaataccactcaatccacatgaatttagagctaacggaacaaaccctaagaaggctcactcggtcacacgtccgcgccaccccaaaataacggtgaaacgtaaatgagtgtgagcatcatatcgaagcgaacactcactccatcactacaaacggcaagactcacgggcaacctgtgcgcgcatcaataatattcttggcgccgctcgccataagaagccaaccgcgccacactggccccccctaccctacaccccctactgtatgctacgagactacgacacggctgtccctgcctgcaccctgatccagttcccggtagcataccacc

SEQ ID NO: 13539 - DNA, 1500 bp, Zea mays
gtaaaagacttaaagagcgcccggccaaggaagcggaacagtcggagcgtacgaagaaaaacacaagccaaagccatggaatggatgctcgtcgcctcatcatacagccgaggaaaaagtaatgatcgcgccgtgccggtccaaacgtttttttttcctactagcagtctagcacccaggaatcagaactagctgtcctatcatcattcatcagtaaaaaaacactaaatcattgcagtcctggttcctgggcatgcattggaggcgggcaatgcaaagggcgacgtcgtccgcgtcaaagcaacaaaaaaaaaaaagttcggtacaataataatactacttgaaacctcgctaaagcagcagagcagaagtgttaggaaaagaagagaatctaatcccaagaaagcatcacacaatctcctgcttttgtatttgttttcgctgccaacgtaaagactaaagagactaagagagcgatagtgcgtgtgtgcctgtgagaggaaatctcggccggagtggactgccatgctatctctcgctctctctctctctcccccgtcgtgtccagctcagcctttggagacaccacctgtccgttgctccaggtgcctcttcctctgccaccccccgtgacgcactgacgctctgctctgcggctgcgcctgcagcacaactaggcgacactctcagacacagagtgagctctccactccgagtgagtgagcgagcgagcgcgcgctccgacatcacatataacaccggcagggcaagcgagcatggacagcaaaggaggaacacggaatccgttcttcctaccgttcgtctatcatccatccgttgctgtcctgatgcctttaccgcttcaccattgatctgagttctgaagaaggtcgtttccctggccgactccttcgccgctgcttcggcgactgcactctcactgcaaggtgacattccccttcgcctcacggttttcttgtgaaaaagtaccgttggtgatcttggcgcccaagttgtagcgagtgttccgtggtgcggttcttgcaacggctagcgcgcagcagcagggtccgcatcgctttctcgttagagatttagagccgggtgctcagcgctcaggtccttggagatttattttgacgagccaactttgctcaacttccaagcggggggcagaggctttgctcagcttctctttttctttgtctccttacctttaaacctctcaagtactctagttcctcccattttctactgctgctgaccaagggggaggagacgagctcgttatcgttagtctggcttgctgatggtagttagttacccacgtttggctattccttatgctcaccgttcttggtcacagaaggaggaaaccaatccaagatcaggcaaagacaggcctaactccaccgataagcttcttgtgctccattgcatagcagtgtcgttccacacggtgtctctcctctcatcgagaaatcgtctccaacgacgaca

SEQ ID NO: 13540 - DNA, 780 bp, Zea mays
aatatattgatatgtgtctctcatgmggaaataaagaaaatgatgtttcctaactatagataggtttagaacttttattttctaaaaaagtagttaaggggattttctcatgtgtattctggttcgtaaatcctagagagcacttgaacataatatgatctggagttctggacaaaagcacaacttaccttcaataagaactgaaatcttaggagaaaaggtaccagacttcaggattaaagcccccagaactgacaggtagtgaatacaaaccgaataactaaatgttaaaaaagacttgacaatctttcaaaagatagacaatatagaatgcactagtaaaaataaatttacgaacatgtgctccgcatattggtatgcctacatcgacaggtccattttattagactgtttaaggcatgtttggttccttgcctaacttgccacactttgactaacttttctgcctaaggttagtttttcaattttaacgactaaccttaggtaaagtgtggcgtagttagcacgaaccgaacatacccttaatctttattttcttgaatgctccatgtagtaggactggctcaataaaaaaatggtaagaattgacggaaacgtaagagaaaagaatggaacgcagaccgtccccggtgtggcacactggcactgtcccccttccaccaaacgcgagaaacttgattccaggcagcaacccctcttccattccattcccgccgaccccgacgccgccctgtctcctcggctcctctctccgatcca

SEQ ID NO: 13541 - DNA, 335 bp, Zea mays
aacctttacactctcatacctagctgttcatgtgctatccaaggccccacagaggctactgaaccatgtacctaacactacaacaacgcagcagtatccgaacgcagtatyatgccaccaagaagtatttttgttatcatccaatccatctccaaacgcataaaattattcgattaatctgatcctaatcatagacatgagcccccctatatactttcctgcgagtttccctccatttctctattgcttcaaacaaggcaatgaaaacaccattctgaggacagcaggaggtggcagaaggagtgaaggagaagggaacagcagaagaaccgagc

SEQ ID NO: 13542 - DNA, 291 bp, Zea mays
ggttgcaaggagcatcccaacaagagcaagacgaagtgaaagcgctcctgcttcaagtgtggtaagattggtcactttattgctaactgtcccgataatgatagtgaccaggaacaaggaaagaatgggaagagagagaataagaaggtttacaagaaggctaagggtgaagcacaccttggaaaataatgggactcagattgctcttcgtccgactccgacgacgaaggactcaccgccacggccttcaacaaatcgtctctcttccccaacgagcgtcacacctgcctc

SEQ ID NO: 13543 - DNA, 152 bp, Zea mays
tctccgcctccggcccggtcggctgcccgcctttataagcgctccgccattttggttccactccgtctccgtcccgtgtcctcgtggcttggcagtgtcgatcgctgatcccaccggctgatagagttggcggccgggagagtgagtcaggg

SEQ ID NO: 13544 - DNA, 1477 bp, Zea mays
gctgccacgttggtaagctcgacgccacaacttatgatgtcgagcttcagggatctaattataattttttgtgaaaaaataaaaaataaaaattcggcccgcaccgaagtcgtcccaacagcggagaacccaaaacggctctggaagactggaaccgcatgctaggctccctgctccgtggccgccaccagccatcaccaactaccatcgtctctgcgctcggctgcgccagccgccagctccgtgcccgacacgccgcaaccctctagtcctgcgtgagcgcacaattcctaccygtcggctgcgcccgtgttagcacctagaaggggataccggagagaagagagatgttctggtagagaagggttgaagaaggagatagcagcgaggaagacgatctgatttgatatctgatagccaaattgttcatgccccttacacaaccactcggtccacacgaccaatcagcctgccaacatttacaaggtccactccagcccaagccagacgggcgctagctttcattagacaccgagcccgctctcctggcgcgtctgtgccttttcccgtgatgcctccatcttcatatactccatgtatggtcatcgttgtcgtagcagcattgttcgtattcttctggtaccatctttgacttgaggagaagatgaggctgtcaggctttttgtgcagtgtgcctgtacgagaggattagagattagaaattagaagaggtgagctagtgaggaagattggagatagagatctagaggaagtccgggaagtgaagaacaaagaaagtattcagatttttaaatcaacaactaatccaagctcaccgagagcagcgaaaagaaaagcatcagtaagaggtacggtgtgttatgtgcaacaacgttgtttaacaaattatatttggttaatgtcatatttggaacaacttcacttaaaaaattttaaatctattttatttcttctatttaaataagtccagctccacgagttctagtttcaaaaaaaaactagaactaaaggttttataaaattttagaagctcctcaaaggatgctttaaaaacactgttttcatgtaccttcataaagtttcacaaaaattatccaccatattattggttatatgagctatcgattaatgtctctttatccacctgctaatcatcaaggataattaataaaatttacaaaataaattatattacaggagttgaagtttatacgtaacccaaacatttttgaaacctgccttatcagtgtgttgaagttgtttcatcgtaaagctgaaaaatcaaagatatattttttaaaataaagtcctttcaagatctaaattactggtaattctttatttaaaatgtactttttaaagatgttttatactgaacttttattttaatgcaatgtatgtattgtccattaccgtgccttatttttgatttgggctccaccactgcacatgaatc

SEQ ID NO: 13545 - DNA, 1215 bp, Zea mays
aaaaaaaaacgaaaaaaaaaaaaaaaggaacgttcaggaaaaaaggaaataaaaaagaacgcccgaaaaaaagaaagggaaaaaaaaaaaaaaaaacgaaaaaagaaaaagaaagattggcgtatacaatagtcagcgggggtactatgcgactagggatgatggtctccagggtcttaatgcagatagagagagtaggacgtttgggtgggtccaacgggagggggccggcattggtatcttagtccgagactaagcaggggtaggattaataggagcctcctatagtgaggcagacagggcggaagcacacctaagtggcacgatataagctggctgaggacaaggagtggtgcaggaagagcagtccgtcgatcatggaggctcccgtggcgagcagtgaaaatgtgtagcacggattagataatgatgagagtgcaggatagtggggtgaccattaaggggagggatgttagtgagaagatgcagtgactgatcagatggtattagtatgcgtgtcacgttgttcagtgacccggaagaggatctggcaggtgatggaagagattgaggctctcgtgtgcgaggctaaggcgggtgtatgcgagatgcacatccgatggaatggacatacaaactccacctcccattcctatacgcgcaactccacctcccaatctcccagtgactgcatttcatttctctacctctccagctgcccacttctcccctgtgctcgcgggcgcgcgcgagtgtggagagaagggagggaattcccccctttctgttcggcgccgtgctcgcgcgcacgcacccgcacgccccacgctgcacgccgccttttcctccgtcttgctgctgcaagtccgcaaccactggaggaaaaatcttttccttcacttttcttccctttccccccgcgcatgcacgggctctgattgacgccatgggggacgccgccgccgccgcagcctccacgtccgctcccaccacgcccacctccattctcatctgcctggaagacggcagcgaccttctcgccgatgccgacgatggcgccggcactgacctagttgtcgcccgcgacgagcgtctgcttgtcgtggaccaggacgaggagtatgtagcgctgctcctgtccaaggagagcgcgtcaggcggcggcggcggcccggtggaggaaatggaggactggatgaaggccgcgcgctccgg

SEQ ID NO: 13546 - DNA, 105 bp, Zea mays
ggtgtaattttttctacattttttataatgttctaaaaaaactgttgctactggtttactaattgcctttttggatattttatctttcaggtattcaacaaaagg

SEQ ID NO: 13547 - DNA, 754 bp, Zea mays
taaccgtacccgtagataaaaaattccaccatacccaatccaatggataatgatccatgattatttaatcatacccgtacacattgccatctctgtcctaccgcatcaaatatttgaatatcaattgcaaatattcaatatagatttaattatatttaataaatttgtctcgtttgtttgtacaattagttttataagtacatactattatatatatattatttaaacattcatacgaagtaaaccaaacaccccccgcccccacgtcgcgcggctaatcagaggccgtgggcatgtcacatccgtgacgtggagtcccgcgattggcccaggccccgcccatgtacgtggccgcccgccaccgtgtacccggcggcgcgtttaggagttaggaccgaccgcccactgtttagcccccttaacttttatcaattacatcctaaaaaaacaggcaacgcggtcttttcctacccaccgtctttagcgcctcttaatgacgcgattattcaagctattcgcgataaccacagggacccaactgcaaacgtggcctgcaaatatctcgtgacctgcgcgggcggaggggacccgcagcccaggccctggtggacccggggcgccagtcccagtccagtccctcactgtggactcctcgcgtgccccgccgcccttaaatcccccggcagcagcgtgctgcctcgtgtctcacccctccggacgaaatctgacccgggccacactccgctgctccgcc

SEQ ID NO: 13548 - DNA, 472 bp, Zea mays
aacagtatttacctttacatgtacataaagaagtctcgataattttttattttttttttctgattagggattcatacagttcatgagtacacatggagggcctaaagacatacctcttcttgattctgttatttctaatgccgtgactccaggatctgacgtatccacagctttaagcagagaggaccgcgaagatatctcactgttgtttttggaggttagagagtttccaatagctaagcaattatttcctctccacgtgtttctttagtagggggtgtacctgttacatttgtattttgcaaattggccatctatgtacttgtgcagttcgattgaatcaccaagcagatggtgacttggatgactagcccacttagcattctcggagtactaagttaccttttctcttagtcataaaaattttggtgctttttacaaagacagccaaatctttcttgcatcaaactcc

SEQ ID NO: 13549 - DNA, 1500 bp, Zea mays
aatacctaaaatttattttaacaaactattttactaatctcttggagttactctcattaaagacatactaaaaaaatttagaagtgaaatactatgactactccaacggttcccttaaacaaaactggaagacaaaaaaaactagcctcaaacttttaaaaaaacctcgttagtacaagtttaatattttaatatatataatttatttatttttcttatcaaacgcaatattataaatatgaataaaagtttgcataaataattctacacgttattatttttaaaaaaggtgaaaacatattcaatttgaatttcaaatttatatctagcacttgaaaagatgtataataaatttgaaatttatcttttatgaatctttacaagtctaatataaaaataaaaatataaatttatatgacatattctatattctatttattcataataaaaaagaccaaaaaatgatatatgtattcgttttcatccctacactacagtcgtgtgtaagcatatacccaaactatacagaacatttaatctatttcgaacgatttctcccctcacatattgagagagagcattcaacctaaattcattcggtgcaagagtaatatggaaaagtagaaatacaaaaatagcagatattattaaatgtttggaatgatttagtagggaaaaagctatgcgtacgagcagaaatccacagtgtgatcctgaactatgagtggtttacagagatgaaatgaacatgggtagtgtgctcacacaagaaatgcctaataacaaggcaaaaagggtagagtgaaaggggcagtcaaaggttgtggatatgatagtataaaacactttttttttataaagtgaagtttaaaataagagatagagtgagtaagttgtcggagatagaagtgagtaaacactttataaagtgtgtttggtaaattgttgtgagttgtctgctgtgcaaaagattctttagttcaaactgatgtgagttgtatgaccaaattatataatttttatatacactttatttaaataaatctattaattaatatatataacactttttatttatattaaaatatttttattaatattaaacacatttttattttatttattataaggcttaatattttaaatcagattttagtttctaactgtcacatctcatgatgaacgtggataagtagcaaaaatatggtctaaaccattttaaaatttgtataaaaagttgtttttgtaaagtagctgcagaagcagattttaaaaaaaagaatcaaacgtaccctcagctaatcacatcgtgatttaggccggcccagcagctggactgggccaaagggccgaaataaagcgtaacgcagccatgaaaggcccatatctgatggagtcgtaggtcgcaagcatacaagtagcaatccccccacgacgccgggttctttcgttcccctttccgccgtgcctcccactaaaccctagatctctctctctaga

SEQ ID NO: 13550 - DNA, 1500 bp, Zea mays
aaatttcaaatttattatacatcttttcaagtgctagatataaatttgaaattcaaattgaatatgttttcaccttttttaaaaataataacgtgtagaattatttatgcaaacttttattcatatttataatattgcgtttgataagaaaaataaataaattatatatattaaaatattaaacttgtactaacgaggtttttttaaaagtttgaggctagttttttttgtcttccagttttgtttaagggaaccgttggagtagtcatagtatttcacttctaaatttttttagtatgtctttaatgagagtaactccaagagattagtaaaatagtttgttaaaataaattttaggtattcaacagcaaaataactcttcaacagattagtaatgtaactcgctaaggtatctaactttttaaattggtttcctcactagctaaacttagctagtcacagctaaactatatagacaatttattggagtgatgtgctatatataaattataatttttataaattataatttttatgaaaaggtaaatagataggtaaatagagagaaaaaaagagtgccttgaagatgctcttaatattttttttgaaaacttttaagtactgttttggagttgttctaaagaagcgaaaccccagcaagcaaacgctagagtgtagacggactgagggagagccctcctcgtctcctccgcccctcctccaggtttgcgtgagatcggcgagcgaatcacgcacacagctgtaggatggagtggggatttgctgtctctccctcttgattgcagtttaatcctttccatttcatccgtccgttcctcgtccacccgagtccgttgaccgttgaagtacaggtgtgtctctcttggttcttgtattgctcttgtcccttctcttccagtcctccgtcagaattcactcatctctcttcccgtggttcgaatgtggttgaccccctgccgattggccttgttctaccgcttcaagccaccttccatttcgtctaggcacttgtttccaatactagttcttggtagggagaaaagactaatcacttttttaaggtgcgactgcaatctaatctttcggatgcttctcgtaaaccctaagctaccattcagttcacgcattgggctcggaaaacctaagccgccatccagttcacgcactggggatttcgtgtcttccttcgaggcgacacgcctctcactatttctcaccgtcgtttctgtcttggatttccgtcatgaatttttgggcgcgatctgatttgttctgatgattcagttcagacattggggattgatattttctcttacttttttgggttttgcttgaatcagctactgcccacaacaactagtactggtactgttatagtattccattaatccattctcatgtgtttttgttttgctgcagtgggacagggagcaaccgccatcatccctgttcgtcatctctcccaccatcaacaccaac

SEQ ID NO: 13551 - DNA, 568 bp, Zea mays
cgtaagggcataataggcacgacgcttcgcggtcccacctgtgagacccctcaaatttactcgtgacctgttttgatgaacgagctcgattaagcgatattttttgacgagttcacctagacacggtatattttgcagagcggcaacatacatcgacatgttttgacaaattcctctcccccgactgagatcactgatccagtgcgcgtgccgccggcgccatggccgcgccaccgccgtcgccagaccaaacctactagcagcgcgtcgggggtgcacctgcggccgatctaggttggtgcgcgctaccgcctccctccctctcccgtcgatgcgatcttctagctccagattgcatctccttcttcttcctccttcggccagggcagaatggctcctcgcgggctgcggttttgtgctcaaaggcgcgatctttacgctcgggatggcttcgttacaggagacagggatttcttctcgtcctgtcctgtggattattacgggcctggatttgcttgggagtgagaggagagagcgagtaatagggtgaaggagtcttggggagaag

SEQ ID NO: 13552 - DNA, 1056 bp, Zea mays
ataacaacctataccaggtgcttttggttcacttagcttttccaaaaggctgaggggcatgtgttgagcaccatttgtggcacctggggacgggcgaacgatccgatcatgtggcccgaacggtctgcgccctggacggttcacgggtgtagcccagaagatccacaattggattaacctgggtagtaaccctttttcccaagtgtgcttatccaattaatcacacggaattctgttaggttacgttcaggaacgggtcaagacctttcttatatatatgaaggggtatgactgattggcgcacaacacggtcgattcaatcaatctatttatcagttcctttactttcttgccttaggagtatcagtaatctagatctagtttaggctttcccaaccctatttttcgtctctcttccactctacgtcgtctagggacgtcttgggtagcctattgaccccggccgaggcacgccttggaactctcctcccgacagaatccctctcgggaggcgagttctagggttctccatggagaagaagacattctacgttgtcgcgcaccgcccgggccttgcggcgcgaaccgtctgaagcgatgcagagatgagccgcttttgcagcgaggtcgtgaaccatccaaccctgtatcatggaccgtctacgcttccacagagaccagtcacgtggttcaccatagtgtttgacctcaaatcagaaccaactcctttgaaacataatataaacactagagaaacacattagttcacaccgagcatcaaaagatactttatgatagctatacctatatcccaccatgcactgttgcggggcacctaagaaccaaatccatcccgtggataagatatgccaggtggcggcaggccagtggggggcatggaccgcgtggcgccctgcgcaccaggctggggataatccgcgcggcatgcaatttgaggccattgcacccttggctcgtacgtacttactcactctccccccacccgcgccaggccagacagactaactgagcacccgctgcaaggagtccgcgccc

SEQ ID NO: 13553 - DNA, 1030 bp, Zea mays
ttattaacatgtgaatcaaaaaacttaagtcagtctgtatgattgtgatagttattaaacatcaaaatcaatatagataatgatttaagatcatttcatatattaaccttttgaccttttgaattgaatttttttttaaatgttgcacgtatgttaagcccactgtttggtaccgattataagatggattattatcaaatctaggtgactaggttatagagagttcttatattgaaattctaacttactccttaaatagttgtctacttattcgtctacttagccgagacactcctataatcttgtttgtaagatatagagcttttttagacttattacaacactttcccctcaattttcttcatatatcccaccatatagccacgttaacaaaattctatccctacttttctcccttccgcagtggttcctcttaaattctcctcctttaccatacaacaacatgacaaagtcataacagaaaaaacatgattttctattgttctcacaaactcagcacaaattactataaagatatttttgtctaatgtttttcaaaaactttagcgccactcaaaaaagtcccataagagaagtcaaagtttgtttttttccgtaaatcacacatattattataaaaactgtagttagatttttttaccaaatctttttaaaaaataattttcgtttagctccacttaaagttgttctacataaggatttggagccatacagtgtgtttataactttagatccattgtagtgggtcatggcatacagctgcgcggactgtcaattatgatgacggcccactaatgtgcacgtgggcctcaacaggcctacatacctgcgcgcaaacacctttaccgtgggctggcccacgtagccagccatccctgtcctccaccgcgtccgactcggacgtgatgtgattgttccggatacatcctcccctcgccagtccccactccccacccaactccacgattgctgctcgctgctgcggctccgctcagatccagtgcccccg

SEQ ID NO: 13554 - DNA, 1113 bp, Zea mays
ttaacggataaaccctggtctcgatcgggctacaagakaaakgccgtccgtccacttcgctatcctcccgagcggccgagtccgctccaactccgcgcatgcacaaccacgtgtgccccgagcccccgtctccgccccctcgccctcgcccgtcccttccgcgcgcgctcccaaggtgggatcagcgtctccgtcttttccccgccactcctcactcccccaccggtgtccttgagagctgcgagcctaggggtgccgccactctataaactagccccattcccttaccagcgcagcgcccgatccccccccccamasgcttggatggatttcatcggtgcaaatcgtgccccgctgcactccgtcgccgccgccactcgacgcagcgcgttcctgcgaccgcttcgccaccacgggctcggcaatcggtgagtggttctgtcgtggggtctcgaatcagatgttgatttggtcgtgccatgctacattccctcgatacgtgggcacgtggcgcgaccgcgcgactcgtctcgatgctgaatgctgtgctcatcgcctcattgtgagtctatggctctgtgcagttctgcggagactaagctcgggatcgcgtctgggtgtggaggaggaggagggtgttttggaaaggcaggtgtctcgatttttggttggttcatgccttggtggtatgctgtgatgctgagctttatctgatccaaacaaatttcgtggtgccacaggtgcagggatttgatgccttgcggtcttgcggagtaccacgacgaaagttcagagcgggaaggcggggagaagtgtgataaaggtatctcatcacaccagctccagggcctatagagcactcttatttcatatgacagttagaccactgcgttcatgatatcgtgttgcttgacattatcatggccattttcaagtgatgcgttggtactgtgcaagtaaaattttgttgtatgcaaatgtgctctgtatttataagctgtattctgacacattttgctcttccgaaatcgaattttgcttctgaacttagtatgcattgtttgtcttgtgttcttttggggataatgtttagccatttcgtaactataggaa

SEQ ID NO: 13555 - DNA, 518 bp, Zea mays
attgccggacacccctcggccatccttggcttgctcccaaaaaagtgccccgcccacctgcacggagagccgtgacacagcgacagccaccaactagtttactcaactccaccgacgtgtaggccctttacttagatagaccccactcgtcaatagcttcacccgtcatcgttctcggtgtcttcacgacggctttaaaggtggcttcgaatccacaagcgaaacgcgaagcagaatgcagtgaaaggctgccattttaaaaccttgctctccggtataaaaaaaccttgctctccttctccgctcgatccccawcccacccgcacggcaccaccaccaatccatccatccttacgcattagctacactccccggcgtcgagcccccgcgaaccctagaccgccgccctcgcatctccgctcgtcgccgcggggtactccctccacccgtctagtgggagtcgcggcgggacgtccccgatccgagctctctccgccttagggtttttggggccggcc

SEQ ID NO: 13556 - DNA, 1500 bp, Zea mays
tttaccaggaagatgcctttcttcttcagtcttattcctcccttctcgaatattatatttatcgtctgttagtattattttgactactttgtgcacgcctaacgacctggcttttattttcctagtcaagtcactgttaagactttttaatttcggataaggcttgtgatagatgagtgactggtgagtagaagttcagctatcagacgggacctgccgtgttccagcttccagtgattgacgtgttccagcttccagttgcgtgaaagacccaaaagagagatccatgcgaaccaaaaaagagaagacacaaaagaagaaaagactctaagtcaatggcatcacaatcatgtagggccagttgaagtgtgatcctcttgctcaaatagctgttacgtggaaggtgtatacaaaccaaaagacagacaaaagaagatagactaccaagtcagcggcatcacaatcatgtagggccaattgaagtgcgattttcttgcaagttgctatgctcggcctatctagggggtaccgtcccactagtaggagataaaaatatacctacatgttttgtaggtgacgtcccactagtaggagataagaatatacctacatgtttcatacgtaatgtaggatgatcgttaaaactaatgttttatagtaattgagattatgatgctctagatatggttaagttataaatgatatgttgttcaaattttatatgttaaaggatatgttgttaaaattttatacaacttgtgggtaaagatgcacaacctctgcagagtataaaactagtatatcagtcgtgctcatgttcattagcgactcggaccctcactgaaatgcggagaaatctaccaagkatggtcacacaatttttatatttctatttagtggttttttcttttgtacttccgggactttgttttgctggtctgttgttggcttcggcaaaaaaaaacctcgtgagcaaatttagaatgagcaccttatttgtttttctagaccttagcattggaaaaattcatattatggcactaaggctatctgcagcgagatgtatatatagacgtgcaaagtactatttacagataatgtagtttgatatatggaatcagatatggatatgaaatctgctggagatagcctagctacgatgccgcttcaaggtttgcatttgaaaataacactccagatattggttactgcattgaaaaaccttttttcaattacattttatcgcgtatccaattatatactggttgctgtgttaaaattctctctttatctccggtcccatccccatcaaaggcgcagaagaaagactaccaagtcagcggcatcacagttatgtggaagtggaacagtcatgtgcgattttctttctcaaaaacagtgaagatgctcaggctgtctgtgactctgggtgactcttgtcttccacatcgccacgccactgattggctcgcgattatgtgatccgtgaaccttcttgcc

SEQ ID NO: 13557 - DNA, 1500 bp, Zea mays
atgccgctgacttggtagtctttcttctgcgcctttgatggggatgggaccggagataaagagagaattttaacacagcaaccagtatataattggatacgcgataaaatgtaattgaaaaaaggtttttcaatgcagtaaccaatatctggagtgttattttcaaatgcaaaccttgaagcggcatcgtagctaggctatctccagcagatttcatatccatatctgattccatatatcaaactacattatctgtaaatagtactttgcacgtctatatatacatctcgctgcagatagccttagtgccataatatgaatttttccaatgctaaggtctagaaaaacaaataaggtgctcattctaaatttgctcacgaggtttttttttgccgaagccaacaacagaccagcaaaacaaagtcccggaagtacaaaagaaaaaaccactaaatagaaatataaaaattgtgtgaccatmcttggtagatttctccgcatttcagtgagggtccgagtcgctaatgaacatgagcacgactgatatactagttttatactctgcagaggttgtgcatctttacccacaagttgtataaaattttaacaacatatcctttaacatataaaatttgaacaacatatcatttataacttaaccatatctagagcatcataatctcaattactataaaacattagttttaacgatcatcctacattacgtatgaaacatgtaggtatattcttatctcctactagtgggacgtcacctacaaaacatgtaggtatatttttatctcctactagtgggacggtaccccctagataggccgagcatagcaacttgcaagaaaatcgcacttcaattggccctacatgattgtgatgccgctgacttggtagtctatcttcttttgtctgtcttttggtttgtatacaccttccacgtaacagctatttgagcaagaggatcacacttcaactggccctacatgattgtgatgccattgacttagagtcttttcttcttttgtgtcttctcttttttggttcgcatggatctctcttttgggtctttcacgcaactggaagctggaacacgtcaatcactggaagctggaacacggcaggtcccgtctgatagctgaacttctactcaccagtcactcatctatcacaagccttatccgaaattaaaaagtcttaacagtgacttgactaggaaaataaaagccaggtcgttaggcgtgcacaaagtagtcaaaataatactaacagacgataaatataatattcgagaagggaggaataagactgaagaagaaaggcatcttcctggtaaagcaatactggcagcaggaattccttgccaccgcgtagcggtcatgacattcacagaatctctcctcccgagaggttaaagcaaatagaaataggtgctcattctgaaacacttgcaaccttctcctcgcccaccttcatctccaaatacatccc

SEQ ID NO: 13558 - DNA, 796 bp, Zea mays
taataaaaaagctcgccgggtcgagcgcggacggcgatccggaaatgatctggactgtaatccgtatggatacgccgatgagaaactggacagcgacctcacctagcgacgaggtggcggcggcggcacgccagcgtggtgcgctggtggtgccggaggatgcaaagggtgacggcgccgccttgacacaggtcgcagactcgcagtggactggagccgatggcacgagcaaggcgaaaccgagtgtgatgcgaatatctagtgagatatgcagttaataggctagtgttacgtaggatgtatacggtgccgattgcctcatacagactgcagcgtgccgtgcgattgtatattcgtatataactcaaactcgtcagagagagagcaggagaagtacaggccaagcagagcaagtgatctgccgcgacagcgagcgtccactgatcgccctcctctctccttttgtacagagtcacgcacggatgctccctatataacatggccaaggactggccagcctgcagagccaggcaccacgcacggaccactcggtctcatgtagctagcagctagcactcactagcagcgaagagtgaggagtgagaggacacggtaaccccagcggcattcgctgctggtacaccaataatcgagcagcgtgcgagagagagagacgaaccgagccacagagaagagggaacgcgaagctactggcgaactgacataacacgcctgcgatcggtagatagatctacatcatctacaccgccgaggcgccgacaaccacttggcgacc

SEQ ID NO: 13559 - DNA, 952 bp, Zea mays
tggacgtttcccgcacccacgtgcagctctaacacaaccttgcgcgggcaacttttcgcgggagtctgatttcgcgcgcgcacggtcgataggggaggaatcgccgaggcgaaaaaatgcggggaggaggagctcatattcgggatgagatggttttgggggggaaaatgaagagactgttggagtgctgaaaacgtgaagttttgccaaaaaatacttttcaaggtgttttaagtgatctgttggagttgctctaacaatctaaataccaacaaagaacactaaaatttctaactcctagaatagaaagatagcctagccaacggcatcatatactgaataatcataataccctctgtgcactctaattgtatgaacaagtgaagcttcagtgttatggctaggcctaagctttagacttccatccctaaatcttacagttttcaattaccccagaagataacattgtgaatcaaagtttaactagtcgaaacattagatgtttttcctgaatatcccttaaggcttgttcgtttcaccgttaatccatttaaattagatggtattgagtcggtttaaatccatagcaagacaaaatctgtcctaattcattctaatacactcccatccacatgtaattggaataaccgaacaaggccttatattatataaggactcttatgatttgaaccaagaggcttcaaacttcaatcctgaaacttaccacttcaatcctgacacgcatctctgttcctatgaaatcccacagttactagtcgttcatcagggagtattaaggagcacgagggcgcagaagtgcaataaatctaccagacttgcagaaatgaatcgaggaggcatagtgtcaggagaagaaagttatgcactggtacattcgactctgttgatcgctaatatacaacagaaatttgggttctccaaatcctgaaga

SEQ ID NO: 13560 - DNA, 719 bp, Zea mays
tcgcctctgactcaaatctggctgataaaaacaaaacgatttgtaagtacaacctgttgtaataaccgcatgcagcttagggtggtaatgggttctatgttttgcactataaaatttaaggatcagatcgaacaagctttatttctatttatttttaattaaaattagttaaggctcaattaaattgtgtaaaaaaatttggatcgtggcgttacatgtagtggtagcaaccgtgtatcagaaaaatagccggtaattatatacatgaaaattctcacaacatatgtatgcttgtagaaataagcaaaaaaagggacattggaaaatatgttaacaatatatttagtaggtgaaaagacgtaaatatattgagaaagtaataaaaaaaggccagctgaccaatagaagaatgacgtacgtgggcctccacttgagcgtttatggctgcgggataaataaacgccggccgaccaatagaaatctaacagctgctattaaaaagggtgacgtggcgcttttaccgtagaaaaataaaatactctcacgtggccggaggtacggactcggagtcacgggcccagaccagaatataacccaaccggctcctcccttgcttctcaattctcatctcaccagtcatctcgtcctagccaggcttcccttgccctaggattgcgccgccgccgatccaaccggcttctccccgcccgacggccgcg

SEQ ID NO: 13561 - DNA, 202 bp, Zea mays
gggataatattgcctctgaaagcatggcatggcgatgcataatttgtttacttgatcacatcaggcgtggttcggttattcttaattcatgtggattggaaggtatcaggatgaattgatatagattttgatttgctatagatttaaaccaatttaatcctatccaatttatatggattaacctcaaaacgaataagccctt

SEQ ID NO: 13562 - DNA, 1500 bp, Zea mays
tccaatatccaaaattacaatgcactcatgatgacggcattgatattgtgcctcacatggatgttagatggatcggacaaccgttaattagataagtagacgcacgtacctttttctagctagttacgtgtggtatccaaattagtagaagagcgcgaacgatcgagatgtatttgtgggtgtcattcgttcaattcatccgtgtcacttgatggcctcgctccaagagtggccccatgacatcatgagaaaaaaaaggaataaatacgccgtggcccagctgcatgatcgatcaagctgatgtttcttgaaatttttcttcgtgttgcttcacacacaccgcaactaatatagctggtcctccgagatatatatattaccacgtatgacgtatgcacatgtcggggaggggggtagaaagagagaaaatatatgcggatcagcagtcttcgccgtgcaaatatccgtgtagtactgatgtaggagtagtggagtagacgcacacacactcgtaattaagcatggcatgaaacaacttgaagagtacaccaacctcgtttgatcgatcggaaaaggatccaaatccagaggattactccagcctacatgcttggctagctagcgaccgatccaccgtcatcgtcatctcatctggtttgccggggcccactcgatcgcgcggccagtgcagcctccagccatcgtggattcgtgggggcaggcaactgggcaagcgccaccagcagccatcgaccgcgcgcagcagccaactgaagcggctcgcacttgtcctgccgggatgtcgaatcccaccactctctccgtgccgtgggcccacggtccacagcaggacgtccccccggacctgcttgcactgcacgcaccatatcctcgcctccgatccatccacggccacccatccgccgccgcccgtccatgtccattccgaggaccaaataatgccagggcatcgatcgatcaggcctgggcctgggcctgggcgtcgtcagttcgcagctcgcggacggaacggagcttagtgcgatctgtctcacccggagctgaggaaggctgcctttcctttcctttcctctcctttcctttccgtaacacaaaggacgtactagttcgtgcacccgcacgcaccccggccagccactaggcacactaccgcactttgcagtagctcccgggtcccggcccgcccagcagatggagagtcccctataaaaaccagcacgagtggcacgaaacgcctcgcaccacaccgagggataagaagaaagaaagaaaaaaaaactaggcattctgcttgcttgcttggggcgctctagtgctcgcttgctgcacctgcaccggtcgcgcacagcctgggaagaggcgagctgaggtctgaggaagccgagaagccgggctcagcgtgcgtacagggacagagacggcaagccggagcatcgatccgttggtgcaagcaggaccggaggatcaccactcagagcc

SEQ ID NO: 13563 - DNA, 1182 bp, Zea mays
tggccggcgggggcggataagcacgccgggaccgaaaccctagactggctggcgagagccgcgagagtaggtggggaaaggcacgcggaaccgggtgcgcgaggcggagagaagacgggtgacaaggctcgcgcgtgacgatatatacatacacggaggatggcagtagaaagctgcgtgcgcgagacgcgagcccgtccaagtgggaatcttttggtcagggaaacatgggccaggccttttctggtacgcggctgatgggccatgaacaatgacctttttggtcgtcgcatgggctctttcggcccagaatgtgctgtaatttatcttttcttttttggtgccgcgcgcgtgtggactgtggtgtgcgcagtgcaggccagaaactgcttcctgttaaaatcttcgttcagcattgttcatgtgactactgtatacttatccaaagtttttccagacttccattttggacgtcccagacaagtcagtcaccgtacgtggacggtacggcgtacatgtatatccatcgaaagtcctagtacacacatccatgattttgtacgaaacctccaaggaatgaatgaaaaatgtggacggaaaaccaaccccgctgcctgctgctgtacgcaggtcgcagggtggctacgaggaacacggacgccgaaaaggagacgcgacgggtgtgtgacggccggcatgggcgggctgcacggcacgcagagaggcagatgcgcaatgccccccgcgagattctcaaaggcatggcgtagcgtagtagttccgcagcagcccaggccgcccgttccttgtccgtagtacggcgcggccggcacggtgggcgccccccggaccagtacgaaccgaaccagtgccacagccaccgccacccggtttgcgtcgccatggggatacgcgcgcatgcatctcacttctgacggccacggcccacgcggccacgccttgcatgcgttcgccggctcaggcttttgatcccgttcccgtgtatatttatatttacacacacccccgtgaagctctggccaagagccgtcgccttcaagtagcctgcatttcggccggccgcccgcccgccgctctagaggtgtcgccatcttcgttgccaattggcgaagcctgacgcctccatccagctgcgacattgccagtagacaccgctaactc

SEQ ID NO: 13564 - DNA, 593 bp, Zea mays
tgagttttcggggttattttcctatttaccccctttaggcgacatctatatttgttcccggataaaggaaactttcaattggtatcagaactaggcatctccatcgtgggcttaaccgtccggacatgacaatgtcgtcataagaggtaaaactggaacttcttctaggcgatgattctaattacaaatcttggtctatctctattttttatgccttcatgagtattgagcctgatttaagatatatttttagtaaaagcattttaccttctaaaattagtgaaaatctctctaagaaagatttaagatgttagtctctcaatcatcatgcttccaacatcttagttgactctctttctagagatgcctattttctgtcatgagtagtaataataatttatttgttgatgctcatgacctatggactataaataaagtaaaatatttgaagtccaaatgcactgcttctactccctatatttcttgtggtactaacatttcaaagggagaagaagaacgatggcgatcaaacaataagtccacctcaccgacaggttcatctcacactggtcataaatgttttgctacaaaca

SEQ ID NO: 13565 - DNA, 395 bp, Zea mays
tgtatggtgaccgtggcctgatgattcccagccagtcctgcatgccctgtgttcgtggccacattcctagccactccagcattgcagttcgttcgtgaggaaagcattgctcataacctgttcttggctattttaagggccgctaatgatgaacacaaacagcggtttagagtgaatccgcaactccatactccaaccagcgctccttcctcggcgcgccttcagccatcgcacagctgaggtacgtaaggttaagttcttggctgattgctggcactttctgccattgcacaactgaggaaatgacactcttttgttcatttgcagcagtactagtaacatccagtttgctggtcaatcaataaaccacttggtgtgctcgtgggaggaagaag

SEQ ID NO: 13566 - DNA, 1500 bp, Zea mays
acccgttaaacccgagggaaagctgctgtcggatataagccggtggccgtcaaaaataacctatgtccgacggcttggaaattttatattttactatagtgatgggtaacaacatctacccgttggatagacgggtaccagtacgggtgggtactaccatacccgcatacctgtgggtaaaatataccagtatcatacgactattattgtctaataaagtacatcttagttaaaataaaacgttaaaataaaacccttcttctaaaacccttcttcgactattgtttacttaactatcaagttatgtagtcatatggtttgttatatttcaagttgaacttatttttgtgtattttttgatattttgagtgatcggaatattggaatttgaattcttcttagcgcgggtatgggttatccgatggctaaaattaccaacgtggatacgggtcaggtatgagtaagatattatactcgtgagcgtatatggataataatatgtgacggttatgattttttttgatgaatacgggtatgaaatgctactatccgacgagtatatcaacttgttcgatgcggctttaatccacctatggctacgacttctacaacattttacttttatggattgcacctagagcagctgaaaaagctcgtgccaccgcagagttgcttcagggaggcgacctgatccctggaaatggtgaagacttcggtggcaagtggtccctcggggtcacagagcatgagaccaggcaatatatcagtaggtttagtagtcgggttcagtagtcagcacaatatgagggtagtaaactttaagggtaataaacaattactccctccgtttatttttagttgtcgctgaatagtttaattttgcactatccagcgacaactaaaatgagacggaggtagtaagttacaacatcatagaccatcccaattgaacaaatacctcatttcacatgcatttcacacattacaaattaagttcatactgctagctagcagtgccacatcgcatggtacatagctatataacaaaactagcagtctagtacagtagaaacagaaattattgaactagaagtagacctaatagaagtccacacaagcaaacataatatattagatatcacaacttagggcgttgaagagttaacataaagtcaccagtccccaagagcatatattatacattacaaataacatataatttcagttaatttgtgtataaattttggttttcaaacctaggatctgaaatagtgtttgagaattcaggtttcggtacatcagttacgagttgggatatttcaagtttggataatgccactagcagcacctagctagagtttcgcataaagaagccgccctagctcctttatattttcagcccccacggtcacgagcacgcggacgtcgccggtggcggtgccaccaccctcatcgttgatcaagtgcacgaatccgccgcggtcggagtccgcccgggac

SEQ ID NO: 13567 - DNA, 733 bp, Zea mays
ctgcagttgagttgaaaattgctaggatataagatggatacatagttgtggtgtccactttcagactggttcctgattggtttctgcagttatatctattcatgtacttcatgtttttgttttgtgaggggatgtgataatcctgatattaaacttttgtgtgctgttagagatgattgaagttttgagctttgtgttctttatatgcagaaccatgatgagtttcaccattttgcgattgaagtagcttcttagtctatactgtccaaagttattgtataccattttcatagaagtaagaccactttaccctttcataattatctattgcaagatgtgttttgatttagttatttgctagtatgtaatatattaacacttttttgacttttcagacaatggggatcttggcactgcctgcggcaagtactacagggtgtgctgcctcagtatcatcgacccaggttcgttcctgttgaattgccattatcttgtttctgtccgaactgtcactgcacaattcttaggccgtcactgcacaattcttaggccctatttgtttcggattataatctgctcagactatataatctagttcaaataatctagtgggtaaacaaacacctagattataggttcaaattatacaatctaaatcccggatcatgataatctcataatatcctcaaaagtagcttatttgagattatttttgtccaaagacccactaccc

SEQ ID NO: 13568 - DNA, 197 bp, Zea mays
ggtgggctgggtatcctggtcaacggctgcatcaaggacgtggatgagaattgagatcaacggctgcgacatcggtgtccgggctctcagctcgcaccctatgaaggccaacaagaaggggatgggcgagaagcacgtccccgttcaacattctggaaccaggatttgcgacggcgagtggctctacgccgaccctg

SEQ ID NO: 13569 - DNA, 943 bp, Zea mays
gacagacacctggttgtatgtgtgtgtgtgtgtataaggaatcgggcgctcttgctgttaaacccgagcttgcaataatggattcttgctggatcacacatttatacttagaataatcgaatgcttgcttccatggttacaagatgttcttggataattctttttttttgttacttgtcaattttctattccggcgacgaagttgattaaactatagatccccttgttggtgtagttctgaagctgagtgttctgtgtcttggccctgtgcctttgttcaagtatgtatttcatcttttgaaaagaagctgtgacacatactattaattaatttgattaatcttatgtccctttgatatttggatgttgatattggaggacatagaattttgtaaagctgattctaatttccaatttcatgctccaatatctgcatctctgaacggagtattagcgaattcagctcaacatatgccaataatgccattgccctcaaggttcaagagcaaaagcaggttgatttggcacttatttaaagtatacacatagtggcaaatttagaagaaatttagggcaccggtttgcaattctgtgaagttatttattagttttagcaggatggccattgtgccatgactgtttctgttgggtaggtggcagactataaaatttcccaacgctgcgttcacccctgccgctctcttctcccgctctctcgcctcctgtagctaggccaggtctcagtgctcattctcactcccttcaaattaccggtgacgagtatccactaagtacgcacaccccttccctcgagttcccgctatttggctttcgtactgggctgtgatccagttacgagacataactgagtagcactctaggtgttcgacggaatgcctctggcaccggttgtgttcatttctgtcccgcagtgtccaggacg

SEQ ID NO: 13570 - DNA, 1172 bp, Zea mays
agtgttttactttgtgtaaagctttctagaattgcgatactttttttgttcttggagagaaagaagttgttatctggcatatatttggctttgagaattttgtaccaagtttcttcagagccttgagatattctccagatctatttaacaagcagacattcattcatgattaaggtatcaacgattcccagaccaccttggtcccatggcctagtaatcaaatcccatttagccatatggtaactgtttctaccctcagccccttgccaaaaaaaaatggaccagaaagaattcattttctggtgaagttctatgggaaaagatagaaacccattgtgtaagtgggtaggctgcttaaacaggagttggtcaaagtgagcctccccctgaggacaaatgtttacccttccatcggtctagccttttttccatgatgtacttaaacgctgaggtttttaaccaacaatctgaaattgggatacctggatacttcatggggagagctcccagcgaacaattgagcatatttgccatcctttcttgttcatgttgagcaaacccaaagacgtacacttcacttttgtgaaagtttatcctcagccctgacatccattagaagcaatagaggataagtttcaggttaagaatggacctatcagagccatcaatcattatcaccgtgtcatcagcgtactggatgtgggaactgggaaatgccccctggaatgagatctcctaacaccccggcgatatgccctttggccaccccctcctctaacaacacactgagattcttggatgtcatgacctcctctaggaaatcccacctgactttgtcgtaagctttttcaaaatcgattttcaacaacagactcttcttttttttagatttcaactcgtgcacaacttcgtgcaagatgacgaccccttctaaaatgtttcagtttttcaagaagccagtctggttccctccgatgagccccttgggcaccgcagaaagcctatttgtgagcactttagtgaatattttgaagtctgcatttagaaggcaaatgggccggtattgtttgatgctactggcatccctgatcttggggatgagcatgattactccgaagttcaaccgttgcatgtctacttctgcttcgtggaaatccttgaacatcttataa

SEQ ID NO: 13571 - DNA, 1500 bp, Zea mays
ctttagtgtgtgatgcttgcttgctcttgcagggtctcgcagtagtaggcactgagttggacgtccaccgaggaagaaggtatcatatgaaatctataaacaatactaaaataaaataagatatcgggcctgctccccagtccccccatagcatactgaaatctgacgattgtcccccgtttcgttttaatcgcgctcgcctctgttgcgttagcagatcatggcgtgccctgccctgccctgcctcggctgcctgagctggccccagccacacaccgagggccagagccaggctgctccggccgcaacttgccgcgcggcggggccccgtgagcacaagggcacacgaaagattcacatgcgaatccaacgcgacgtcgtcgggctggggtgggtttgtgctttctctttcaccacccaacccgctttccggttcccgggagacggcaacggtagccaccaacccttcctatgacacgagcacttgcactcgcgttgaggtgcgctgctacgggtgacgctttgcgccccgctccggcgactttcgctcgtgccaggtgaaagcccgcccccggccggcatcggcgttgctagcagtgctgctccgctccggtctttacgctgccattgcgcgcgggtgaaagtggtggcaaagcggcgagggccgtggtccgtggagcttttgggcgtcatgtccactttaatatcttcagcatcttattcatatctatacctatatttaaactctattttaaaacaatacagtatatattacatatcattaaaaaacaatgcatataaataaaatttagataatttgctggagtcggtcttgtatagccctttacctcaggcagtaaaatgttcagattcggcaaacgggcacgggctatataatcgtggaaatagaggcgcagcgcagggcactgtttccgccgaggcccttttctggcgccggaccaccgcaccatggcgtcccttgtcgcgagccgatatgaaaagtttgtggttttattatttttttttctttttcttttttacctagagcgcactacggcactagagagctagagcatccttttttcacaccgctatatctgaggaagtggtgcgtgtacctgctgcgcaccaattttggtatagcagctggagcatctttaacaggtactacaacgaactctgaacttccagtcttccaccatggtatggcatgcatgctttcccttttccatggttgactttgttagcattctgttgtatagcgtagccaaggttgttagcatctatattatgctagattaactcctagattagctcctagacggttttagttttgtatctatcatgtgcacgtgctatctatataaagaaacaaagcaagcaccgaggtgctgtgccaccaattatattcttcctattgcattgttcaacttggtaatcagagcattcgatccattttttcccccacccggcccatcgtccatcgttgctccagtattt

SEQ ID NO: 13572 - DNA, 954 bp, Zea mays
cagagttgcagtgcagggcagctggggcgcccgggtgggtgatgagcccgtgagggcgagtggacaacgggtttcagctttttctgaccagcttttccgagaatttagctgtgggaagaatctaagtatcattaggattacgtgtggagaaagataaaattatccataagactcagaatctataaagtgacagattactactattgcgacgactcaaccgattatatgtttatgttgattttgaatagtttttacccaaacgaattttatagaagctgactgaaaagctgagtgtttggctgttcacggcagcttctcgtgaccagaagctgcgaaaagccgaaacaaaacggggccaacgattgatgaagcaactgtgccgcgtccgcgtcccgtcataaatatctgctacaagcccacaatcacgaacatttcggagcaggacccatttctcaggcccagtacttttctaggggcaggcatcgttgttcagtttcttctccattatggttgatgattgttgaactgaaagactttgtaggttcttttaaattagatggagaaatacagcaaatcccaagatgctgtatttgaaagtaacgcccattacaatgctacggcacaataaatgaatgaaattgttggtgcagccgaccgagagcaaggcggggctgtgcagcgtgaccggaggccgtctatcagtgaacagataaacagagaaagcggccacggttgagagttgagaggccacgaaccccaccaagattccacaaaactccatcaccagatccagaacccacttccacttcctctctcgtgttttcattttaggccagaataaactccagccacttcggcatgcgccgggaatttgattcttctgcctaaaatagtcacgctaccttccacctccccctactactctgactctccctcgtcttcttcgctaccaag

SEQ ID NO: 13573 - DNA, 529 bp, Zea mays
attagctaaatttatctttacaaaaccatataactagtctcttagagttgctttaaaattgcctagttaaaaattaactattattaactatattagctagttatttttagtgtaaatagataaaaaagcactaagacacaggaaaaaaatgctatatttttatctaaaccgctatatacttccttttttgtggacgttggaggctgaatgttatattcttctatgttagataatctttatttagataacttagggtcgaagtcaactgcgcacttttcaattcacacgggacgggaatctttactccaggcgtttccataaaacacccagtctagactaaaaataatcacagctgtaccaattgcagcattcttatcatcttatggcagcaaaagacccttttctacgccactgataaacttcaaggtttcttctgcagtttcttttctcccacacaaataggacggagaagtcgggaacatgctaaggggaacggcgccaccgagaggaacgcgaggtcgccatcacc

SEQ ID NO: 13574 - DNA, 194 bp, Zea mays
gattggcagtacgatcgataaagattggaagagttgccagaccatatcaatcccacccccaccacggcaccacccgcactgtgcagcagcctcctttcgtctcgtagttggctggggttgccaacgcgacacctcgtcggaatccggtcgcgcgacctccacttctcgccggccggagcgggtgcgccatcacc

SEQ ID NO: 13575 - DNA, 219 bp, Zea mays
ggtaggtcttgaataacacaccccctctcgttccctccacagacactacaaagaaatggaaacgttatgttcatatggttcttctattctatgaaatgtatgtacatagtacatacgattctcaaaagttgaaggtatttttttttacaacgtgcagggttcacggttgcttccatttgctacctgcagttttttccactaccatctgatgaaaatggt

SEQ ID NO: 13576 - DNA, 570 bp, Zea mays
gctgtttgtgtaagatggccgaaggtccctcttcatgaagcttcggtatcacaaaccgacttaaagatagaatgaccttttagtccataaaggtctgagtcaatgttgtaaactttcataaggggcatacttgtaatccctcacaggctgcgccctgtgcctataaatagtgaacagtattcctttactgttcacgcattcctgtattggcaatcgcatcattcgggaaccaatctttgccaagacagaggtataactgtattcaatgattaaatatactgagtaaatataatgtggttcatttatgattcgtttacctttgatactctatattttatgttattttatacaatctattaaactacaattacgaagatttaatcttcgcaatcgtattgtcatcaaccttcgtccaaggtccattaatccccaaaggaataatgcttcgttggacgaaggacattaacatttaaaactttatgttgccttgttcttgattcatagcatttgagaacaagtccccaacattggcgcccacctccggtgaactcacttccactttttgagctg

SEQ ID NO: 13577 - DNA, 277 bp, Zea mays
ggtaaatatcgcctcctttttcttcagatatatatgcttgtcggcgaagtccttcggcgttccgatcatcaacttttcttccaatttgtagttctctctaagcggaatccttgtgttcttgagagagagagagagagagagagagagagagagagagagagagagagactcagaaaggtagcgcagaggtgagatttgtaacctgtaataagtgacttgtggcgctgaagatcgaaagtcagagaaatcttgtggatacaagctccacctccaagga

SEQ ID NO: 13578 - DNA, 136 bp, Zea mays
gacttgtaaatattagtgagctactgagctgcttagctgacctcttccattaatttcttgattaatcaccatttcattttgctgtattatgtttacgttgttgaatctagccctcttttagaaaccaaagttttgt

SEQ ID NO: 13579 - DNA, 266 bp, Zea mays
gattttacaaaccactcacaaataacgaaattcgatttcgctcatcacgagaaatggaaaatgagatggtaaaccctgatcagcgtctcccttgaccttgagaagtccacgggcctaccgaacgaggcccccgggcagtcggggcaaacccgtccatccatcctcagccaacgcgccaccacaaccaccagcccaccaggcaccagcagccaacgcgccgcgcccttcacaaaaaataaaataaaataaatgaataaacgcaacgg

SEQ ID NO: 13580 - DNA, 740 bp, Zea mays
cgtggagaggcactgtacccacaaccaagaaccagccctgcatgattgaatcacttgtcaaagtagggtgagccgtctctaattacctttatgttcatgtgttttcaaagattccaataacataggaggatgaagccactgaaaccctatcctggaaaagaatggggacaggcaagtttgtggaggcgggagcgagaggatgcaataccagcaacaatccagaaggttttggcaaagctacagtggaaaagcatgtgttacgaattgttagggttctaaataattttagttaaaaataaataaaaataaagtttaattccaattcaatctgattttttaattttatagcctaaaatttaaatcctattatcaccctactcgtgtgacaaaattaaaacgaagttgaaccaaactaacatatttcgtcgagacggtatcactatcattgacccccgggtggccggccgcccggccgggctcgtcggtgactttttttttttagaaaaaagaagattttctttatatgaaagaagaggattgtaatttgctagttgattaattaacggtgaagtagttggagttgataggttcccaatcaagtgacggttacattcttatcgtaaatagtttttgcacaaacagagcggaaaaaaggaacagtttttgtggaggtgactcctcgcctgtgtcgtcaaatcctccacaccctggactggagtggctgctgctcgtggccggcg

SEQ ID NO: 13581 - DNA, 1500 bp, Zea mays
atgcatgggctgggccgataacacatcaggaccacgcatgcatgcgtgcgtgcgtgccggccgctgggaatagaagaggcccgggcatgcagattcccgatcagccagagcgcgcgcgtggctggcactggcactggcagggctactgcaaatttcactgtatgcctttgccacacgccmaagcactttttttcctytccttgcatgcattgctggccgagtgcacaacgtatgcactgcacaccacatgacgacgaacaaggtatcgcatgcacgctgtggtacaatgtcgtatatatatggctcatcttgggccggggaggcggtagcagctagcagtcccaactcccaacagctaatagcgtgtcctggcatgcatcgtgcatgaggacgaccggacaaggccaacagcaacagtggaaagaaagctcgatcatatgtgcatgcaatgcatgcgatcccccatcatataccctactactcctgtccgtcgccggccggccgacgcccatcatcgtcagcccatgcatgcaaaaggcaagagccgggaacaagcaaacgctagtgattcactgggccgcctaccgtagtcgctttctagttatgtcgtgctcggacgattcggaaccaataagcatgggcacatccacgagtcgctccgtgtggccatggcctagcagccatccagctagtagtggctagtagaggtatagctatacaaatacggtgtgattggttgcgtggaggagtgtggctcatctcatgcgactatgccagcttggctcgttggaaacgaacgctcgctacgtacttaggccttgtttgtttcggattataatctctctagattatataatccagtgcaaataattcagtaggtaaacaaacatctagattatgagttcagattatataatctaaagtctaaattatgataatcttataatcttctcaagagtagcttatttgagattattttggtaaaagacccactacccatggttatataaatagaaattacaatatatgccatccttcttttctcacattaaataaataaataagggtattgttgtctttatgaataatctacatttgtataatctaaactatcaaacaactacatatagattataatatatctagattataatctaaattatataatttagattataatctatattatataatctataagttgaaacaaacatgcgcaaatcccacgcacaaaatcatcatcatctatttccgcacaaaaataatacaaaaattagtcgtattctttaagaaccaatccaaacccaagcaaagccgacccgccccaaatcattcgtctccctccccttcgttggttcgtttgattgattggggagcaacaactcccaccacccgcaaccgcagcaatctcccctcgccaactccgtctcggccgcaacccattcgccattgccgaggaggaggaagcccggtcgtcgtgtgaggtgttctggatctcgg

SEQ ID NO: 13582 - DNA, 1388 bp, Zea mays
ggcgacagaggagtgaccgagccagaacaacctgtcccacagccactactaaaagcatccccaccaattccatacttatttaggggtgctattggactctatattttatattataaaatttaattatcaaatccgattagaaccaaactctatttctatttatttttaagttaaaattaattaaggatcctatgaagaaatatttagatagttatccattaccacctctatatatatcctatatttttaagccccactctgtaacagatagtagtctactaaattatcatatacacaatccaccagtaatagcgtaagttgttttcatccgatatccaccagtaatagcgtaagtcgtgaaaaacctatattgtttgtaaattaaagtttaaaataataaaatttgctctgagacattccaacgtttaaactggtgccactacggatgctgacccgtccgcccccactgcagcctttgtcaggcaagtgagcggcgagcgctgacctttagctgaaaatcactgtccgcctgcttccatgctcttctcctctcctccctccaacaccattcaaaaagacctcctcctcgcttctccaaccacatctcctgcaaataaaaatcgaagtgataagataaacaaatctttttttttcaaccaccgatcctattaaggacctcgcaaacccagatatgttcctgaatgattggctaattcagcagccgcaccttagactattttttctggcatcaagcttctaagtagatgagcgacgtagaaagatggagcgacatgagaaaacgcaagtttggactaccaaattttaaaaaaaggattagactttagagcttacgctatctagttttctaacttatcttcttcctcaatttttttttgttcagacttcagaggagcttctgtaacgttaattcaggctgggcaaggctatgtgtctgaacattcttaaggctcattcagttattatcttctgctcctagactttagctctctctatatatatatatatatataatggccatgtaattattaagcatcgtacaggtaggcccctttcttttgcggttagtgcttgtctgattggcattacttgacacagcaacctcccttgccaagcatcttaccaaccgccatcaccatgttataataaccccatttgccgaccaccacttcagtttcaactacagaagcaattaattagattaacccacatccctttcctccggtcctctatttctagtcatttccatgtcaagaggcggtagataaacaagttgcaaccacccatatacatcttccattccaacacaggcttccacaatagagtcagagctcacagctcagacctagagagagagaaagagatttgca

SEQ ID NO: 13583 - DNA, 1500 bp, Zea mays
tagctattccgatccaagcataattcattaatatttcttctgcgaaacttcgacaacattatttgttttgatatccctgagccttgaaaaccaccaaagcttattggtttatatgagcgaatggtcacactgaaagctaagatagcttgaaggagaatttgacacttcctttgacgagatcctatctgtcaattcatctagatggtcagattttgcaagcagaatcatgcgctacctgttattagataactgcattgttaagttgaccatatactgccatgtgcagccaagggtagcagtagctgagcgaatcccacttgctcttctctatgcatgattgagaagaatatcaggaaaaatgttctctctgtgaggtccaaatgcggatgacttctttttgctatacataaagttctgaagttttgtgatgctttgttataagcaccgattttctgattcatatagaggttgattttgaaatacagttgacagagaattgcttttacaggtttcttttaggttagtttagtactttatggggctcacggcaatctctcttacggatcaaggtatcgtataatatggcagttcatgttcatgtttcgttgttttactggtcaccttaacctaccgtaytaggttccagtttcgatgctatttaagaatgtttcttcttcaaacatgattcgcggggcttcaataatgcagacacccctcaacctgcagaatgatgctctggtcgctgagttgtatggtaccgagtggaaacagcaaagcggtttgttaatgatcgattttaatgcctgtatacctatggtatccttcgtagttcgtgtgctctaatacacatgtaatcccatgttcgcgtcttgaaccgctaaataagtgaaccccatgcatatggagatattttggtgaccccaaagttgtgtataccatttcattgctttaccctaccatgttctgtggcaagagaaccaaatctgtttaaacatctgggatgataatttatctcttgggcaaaaacttgtgatgtaagatatgattcaaataaacaactttgtggggggccatttcagtatcacagtaggcaaaaaaaaaaatttggcagatccaggtttctgggaaataccagttgaagcaattcagtttttgtgttgtactgccacgtacatgcgttgtctaagccaacaaaccttttggcttttgcttgtgaaatgaaacttgtgtgttctgtgtgatgcaatacctaccactagcaggcaagtgtataagctggtatgcatgcgatggcttgaagctgacacgctcagtacattctctacaactaattcttgttgtctacttgggaccaaccagttggttggtgtgtcgtctaccgccacggctgcactccacatgtcccttctttatcatgttgctcatcttcgatagatgtcatgattcagtgaattaagcatttatatttgagaaaggggaccggttttatgaataaaaaaa

SEQ ID NO: 13584 - DNA, 1188 bp, Zea mays
acaatttatgttacgatcataagtaaatgtcagggacataaatgtacttttactcgggttgtgtctcttgtctataaataaatgaacagtagcaccgtactgttcacggtgaattgcaatcactctctcgtgtcttcacattcgagcaagccgaagttatcaatgtaatatgaattatgttgatattcatacatgttttatggaatacaaataagaatgaatcaatgagttaaatttgttgtgtttatctcttacattcttgtttatctataagatgatgaaggcatgtctttcacgaccttygtctaatgatcattatgtccatgaggagataatgctttggaagacgaaggtctttaatacttaacatttgtgttgccttgttcttgattcatagcatctgagaacaagtgactaacaattgattttggttcttttctagttgtcttctcgtctgattaagccaagactaaggagttcaactaatttgaatctatgatctctaaataaatttatgaatatttgaatctgagaatgaatctattttttataaggtagatgagaaaaaaatttagagacacgctatcaagctatgggtgacacgacttacaactttgttcatactttacaaattggcccggtaaaaaaagacacgtagtgtcatatctagactgttagcatggcctgtaacccttagaagcatgagacgggagcacgatgtgtcgttttttgcccggccattgtggcctgtttggttcactacctcagttaccacactttgcctaaacttttctgtctaatggttagttattcaattcgaacgactaaccttaggcaaagtgtggtatatttagccacaaaccaaacatgccaggcgggaagcgagccaaggccaggtccaggccaaaaaatctcacgcttcgcctgacgcctgctcctggtcgttacagatagagacggataagcatgacagcgcaggccgcgcggcgtggactccatgcctgcaaggggacaatagagatgccgtctgcgtccgcggcggcatcggcgccggcgtcaccccccgctataaatccgtcgcacccgcccacccacctgccgtgccagtgctctcatctgcgtacacggtctccctcttcctgtcagtagtagagtgagagtgaggcagcgagtaggagacaaggggaa

SEQ ID NO: 13585 - DNA, 1500 bp, Zea mays
tagtctcttgatgaatgcgtctatggcggcgtggccacgcaggattgtggcagcacgaagatgtcaattcatttcataggtctatatcggttcgtttcttaacctcaaaaatatttaatataaacggatacttgatgaatactcagggcgtgtacaacgtagagaccctaaaatagtttttcaaaatataagaaaaaacattatataactctaataatcctctatatcataaataaatttaagagacaataagtatagaaaatcttgaaaagacggacttttgatcttttttttatttaaccgccctatacatccctcgagagacgcctcaattaaggccatgtacaatcacattaattgagggttctctatggggttaagtgaaagaaaattaagagacggtctcttcacgaagaccccctctcatcacgactttttatacttattgtttttaacggcatttatgatctatgggcttaaggttatatcatgtagtctcttagttatctcatatatttacaaaaccgttctagcatctctagatttgtacatgccttatagttagaggcgggtcccataagtttggaggctccgggcggttgccccttgctcactctatagaactagccctagacatgtttaaatggtcatgccggtcggtctgacctagacacggctaggctcggcacgacgggacttagtctaagcccgacacggtttagtatcatgtcgggccgacctacgggctgtttgaagcggccaaggcctagcacggttgttcttacatggaccatgctgaccaaggcacgcccgccctagtagtggcaggctaggcccgagcttataaacagaaaaaaaaacactacaaaattcatatttattctaaattcaatagattacatttaaaattttagatacatacttaaacacaaaattttatataagcacataaacacatatcacattttattatactcccatataacaaacagaagtataagtattattatacctaaaaatagactagacgttactgaacttcttgtgcctacaccgtagaccatactagcggtccaagcccgacatagctaccggaccacgtgtcgccgggccgggccatttggccctgggatcgatgtcctgctatgccagtggcgagtggcgacaaccgaagaagaacagcagacctctgcatgtcattgtcattatgcttatgcatgcgtagtatttgcttctttcggaggcctgtttgtaaaccccagcagacgaccaaccaaaaaccaatccttctcgatcggtagatcttttctgaggctcagagtaaccttttgtggttctctgtttaaaatagagttgccaacttttgtggtgtggatcagctcactttgcgcggcggtggctggcagtaatactgtgcattccttcttggcgtgttgcgtgtagcatagcataggagcgttgtgtatcagcaagaagacgacccttggtacttggtaatag

SEQ ID NO: 13586 - DNA, 895 bp, Zea mays
agtaagagatggcgacaaatttgccccgatacattacccaggaacgactaggacaaaaagggctaggcaacagcagctccatatatgcagatcgatcgatcgatatgaaatgataactcgcgttgattgcttaattcacaagaacaaattacacaataatgctatagtagtgttgtagatagagacgcctgattgcttgttctgaggccagttttggggcaggtcccctattcaaagacagcccacccttttctcatttggtccttttcttccagaactgctagctagcgccaaaaaaacacatacgtgcatatggccatatacacgcatggacgtacacaggacaccccggccattgctgtgagtgagcctttcagtatatatagtcaatgcatccatcaatcaatctaaaactatagtgtacagctcaaacccatctgccacaggctatatacattttatacacgcctagggtttgtctttgttggtacgagcatcttggacttgataccccccggcccttgctagctccctcacccccagtccccactatactccaactccatataaggcagccatgtatccctttcccttgcattgtaccatcacctcttcctcttgtttttcttgcctgtctccatactcaccagttgcttttgatcgaggaggctgatcgagctacaagcaatcgggcaaaggatatttccgaggtctgtggtcgatctgttagctttatatatgcaggagccatgaagtatatatatatatataaggatagatcttgcagtttgaagcatctaattttgtttcccatatctgctcttgagtctcgactcatggtgtgctgcttcttggatcttacttagctaggtatatattgcaaggaagaattaat

SEQ ID NO: 13587 - DNA, 950 bp, Zea mays
tttaaggtataagatcctttagaggacctattgaagacaatctaagctggatttgaattggatgtgttgaagtttttgacggctctgtccatgttcccattaggctataactattctgcggtggttcctattaggccattactattatgctatgttaagacctcacaggtgttttactgaaacgtgacgaccaggggaaaaagttggtagttagggctgtaaacgagtcgagccgactcggtggctaatcgaatttgacttggctcggctcgtccattacacgagctcaagaatgaggcttgggttgactcgaagtgggctcgacttgcgactcgcaccctcgtaaatattattgtattataaaataaattaaaatatataattgtgaaatataaaataatcattcgatattatgactaatttaaattatgaattgtcttatattcatcataaaaagctaagaaacgggcttattatctattgaactgtacaatattcattattaatctgcagattaattaagttactagtgtttacggaaaagattagaagaatgtggagctctcaggaagcaacggaacggaaacgttgagccctccaaaatatcttctggtctgagttcggacaggcacagataggaccagcaggaggcacgtgacagttgccacatccaactgatacgtgggcccataaaactccattgtttatatagaaagaccatccaaagcagtacaaagactctgtttgattctggattcttccggaatcccgaccatcccacggagccacctttcagaaccttccttcgccttccagaagcccacccgtcaccaccatataaaccgcccctgttcgcgtcggcattccccacaccgagaatcacaatacgaaacgaattaatccccaatcaacacagcaagtcagcaacaagcaaagcagcgatccgagag

SEQ ID NO: 13588 - DNA, 103 bp, Zea mays
accgcaccccaggtcgggaatcatggcaccacataccactgcctcgacttttgccggtttgaacaggcaggaccccgcaccgctcgccggcagatgaagaggt

SEQ ID NO: 13589 - DNA, 1500 bp, Zea mays
aattgacccatatatccatatttttccatggtggcatcgaattaaaaggatacttgaaagcatatatacccttagtttcataacaacataagattattgtgactaaattgagttttgtaaaaaaaggtatgttaggtcataataatgagagattattaggtttaattatgtggtattcatgcccttattgatggatatcaatggtcgagttgggtgtagtagcaccagaaatgtttgatgggcatgggatatggacctccagaaaggagtgtaccttattgcgcttgagtgtagcattggtgtatccgatgtgcatcgaatatggtgcactcgatggagcacttagagagcttgcagaagtgacctcaaatacatatttagtacttactagatgtgtctagtgtaccacctgataagatactcaaggtggttataaacagtgtctgagaggtcaaatactcaccgaacaggatactcggagaggtctacaactatgcaatgagagtagcttgtttgcattcaccatcctcgttatacttggtaaggtcaattggtcaagtgagagttagtgtttattactcttggcgattgttaacacctaaacaactcattggcgattgggagtgtggtgatcactcgaagagcttctggatgatccaacctaatcttgtacatgattatgaatgtttcctcatgccagagtgacaaagaaccagctcatagagagtacttagcccttgtgtggaccaatagggaatgacactcttgtacgaaccaaggggagcgacactcttgtacgaaccaaggggagcgacactcttgcgcgggtgctccaatgagtattagtagagattcgtgactctttgataccttattaaatctccttttacattaaacattttatattcaaataatttattttaagtatttacatttttagaattgctatgataatataggattgaaactagggtgcaaaacttctagatcacacatctaggcacaaagaatgaatgtgtgaatgattatacgttttaattggtgtaagaaactttagagaagcctaatttagctcctcttgtgcatgcattgtcagccagcatgttgagctgaaaaacagaagatacttctaatcttgtattgaattaaaagaagttaacaaggaacaactctacaaaaccataactgaatccaacaggcaccccacaaaaaaacgttgcaattatgcttggtacaagtccagtaccgagagtcagcagtagtcagtagtcactagtcactagtcagtactaactgattggtaggccagtcaggcgaccaagtagtagtacttcgactgcgctcccccctatcctctctctatataaacccacgcagccgcatttcactcgcacacagcaaacacacgcccactggccaagcaccaaataacacgcctcgtgtcgaccagcgagggccaaaggcacgagcagcggcactagcaatacgcactgcagtgcc

SEQ ID NO: 13590 - DNA, 1500 bp, Zea mays
ggttataatatttggacaacaaaactgcaccgaagtaagtgattggagaagtggtagatgtggttacactcgaggggggagtcgtgggtttgattcccacaggccgcatattttgcgtgaaaaatgttgcgacttgcgatttcgatggagacaggcgaatgtggtcgcctcattccatcccttaaataaaaatacttttttgctattttaaacctatttttatgtttcttggaaaatattttcactggtgattttattacctcggccgccagtacaaattgatttccagtggaggttttctaagctcatctaccagtggaaatcgatttgcactgacagttctcaattatccgcatatagaaaaaaaaatttatttctactgacccctagtaccgcagttgtaaaaaacgccagtgaatagatttacaactgtcagtatagagcttctgtgtactagtgtggaagagaatagagtgcctccagtcctattttttggatatttggtttccaaaagagaaacggagtggctagagtctatatatgaaaatttactataaatagttggagtgctctcactccaccaaaatgattaggtgcgagcgctctcgtcccttctacactctcacatggctctctaaccaaaaaaaagaatggagcggttccactttattctactctttaaccaaataaaaatatagagcgactctattttacttgtcaaatgcagaatagaattatttcatcctaaaaactaaaatatagtcgttttattatagtcgactctccaacaagcgcaccgttaatctatctcatggacggtaatagcacgagatcgagcggcacgatgtatataatacagatgaaggggctttgtttctgccgcggctgctgcatggagtacacgccacgaaacgacgataaaatcatatcattcgctagctactcgctgctagacggcgatcgtgcgttcatgggaacttaccaatcaccgccccaaatctccctagatcatgagacgcccacatgccaccccttaatcccctgcctcgaagaaactccatggcgccgcctgagcttgacatgcactccaagcctagctagtttaatggcgagatcccaaaaacaagaagcccttatattaagctacgtacgtagcttgtatttttttttcctgtcaaacgagttccgayttccaagtcaccgaatcgttcgtgacacgggcaaatgttgggataaggctccatggatgaatgtttgaggtagaactagacaagaacatggtaggcctcaccggcatttacacttgcaaagagccctcaggggaaggttaccagagagacgcgcgattcccgcgcttcagagaacggacacggttactcttggatttgcacccctcttggtccaagcacgcaaggtggcgccacggcgtccggtctttgtcgtcacggcgtcccggcaccgctacaggcgaagaattgggggtcggcggcgttggccggc

SEQ ID NO: 13591 - DNA, 1272 bp, Zea mays
atccagcctagtactctatacttaataagtctggatctactagtaataaggtataaaagtatcagaattctccaaaaatgtccagcaagctgaactacttaactcttgccggagaaattgtgcgagtcaaaattagaactggattattaacacataaggccttgttcgtttgtgccggattgatgggtcggaatgattcctaatcggattatttctctaatttatataaactttgattaattggaacgattccgagtgaaatctaacacaaacgaacaaggcctaagggactgttcggtttactcggaacgatgacctgaaacgagtcgtagccggattgtttgtataatttacataagctttgatcaaatgaaactatttctagatagaattctggacaaccgaacatggccttaagcatctaagcaatttaagataaataaacaaggatccgataggcaaactgcccgagtcgtttcagatgagatggagtcttgataaattttggactatctgccactgagggtatggacatactcgtacttgtctcgttatccacgctagctgtccatatcatcaatctgtttagatattgtatctcaccctctccaatcttatccatgcatgcacattggataatgattaacctaacggaagaaaactatcactacaagttttttgtttctgcgtgagtacgtctttctcttgtatgtttttgagcctcagctcttttctcttattaataacttgcatattcgataaaaaaaatatagcagctggtcactcaagtaagtccatcttaccctcccttagacatacttacaccatcacacgattccacgaatagacaacttggatacaatcttaaaataaaaattaatgagttctaatacaatccgttgtagtctagctggtcaggatattcggctctcacccgaaagacccgggttcgagtcccggcaacggaatgactgtgtttttttttttgtattccctgcgtttagtcagctgagttcaaccatggtcacgcgctctgcaaagaccggcttcgccggcgacggaagcacgtccagccatgaccagcgctctgcaaagagaagtatgggtggctgatcgcaactcgcaagagaactgagaagcgatggccatcaagattgacagaagaagtcgtcaaccggcttcattggtcatcctccacaacgaaagaaagaaagcagaggatggtcagattgaaagaaaaaaaaacatgtgtgatggctgttgcacacccat

SEQ ID NO: 13592 - DNA, 362 bp, Zea mays
ggtacccttaattatggtccccgacacgtagcgttaacgcatgctatataccagtattaggtatttcaaaaaaacttatggatctaatgttgacggaaccgtagtttaacaagatggccaggcccaaattttcaattgtgctgcaaggatgagaacccgcctaatggcctaaggcccaaaagggaaaagcccaatctgatgctcagaggccgaggccctacggtgacgttacctcaaagtctcgaatgaaccctagccgccgctgcacagctaatctgtgagcctcgtctactgatagtcctgtcctgtttcactctcgccagccaaagacgaccacgccctccgtgctccagccattcccc

SEQ ID NO: 13593 - DNA, 125 bp, Zea mays
ggttcgatctggaagcatatgattctctcataatcatgtagaaagagatagagggtggcgctgaaggtgtagtagttggaggaaaaacaggggagggccacctcatgagctaggatgagcatatc

SEQ ID NO: 13594 - DNA, 1500 bp, Zea mays
tacgaaagagagagggagacagggaaaaaaagaaacgggaaacaattggaaaagcagctcctgctgaaaacgtctttcactacagcagcagcagcgctgtctgcaacgaacggataaaaaggcgagccgccaaagcgcggaaaccgactggattggaccgccaaagtaggaccgcagcacatgccaatgccctgcgtccgtcccatgggccatggccataccataccacacgaggcggttaattagcgagagttggatggatctgagtatctgactgacctcctcctaatcgtatcccagttcaaactatagtgcggttgcgtttcaaagcgtatcctgggccaacgaccggcacgccccccggtccgtccgcggacgtacatacggaaaactaataaaacttggcaaccaactcctcctcctcctagcaaggatttggatttcttttgaatcctttgacgttcgtctaaaccaaggtagctaggaccagaccgacttgttcttattatatggacacgatttgtttattacgcgaaacgatcggtacggacgtttaaggattgctcgaacatgcgtgtctgcggcggatgggagagctagatctgatcgggccatcacgtcgtcgatccgggaacaaagccggaggcttgctactggtagctgggacaaacacggtggtttgacctgacaagccgattagctgcctgccttcctgttcctacctagctgcactgcgattagagagtcaacgctgcttgcatcggagaacggacggacccccggatgcgtgtgtgtgtgtgtgaatccaggcccacgcgcgcgtcgctccgctagctctaaacattttaccgagaccggacccggaccagataccgtacgcgactttgggtgcgcaccgccatgtggacacgcgctctcctcggcgaatactaaacattttatctgctcctgctcgcgcatgcatggagctgacggaactcgctcgccgagtcaaggcggcggcaaagtccaaggcacccgcccggcccgcgccgcgcaccgcgtaggcgtgtagctagcttgccgcggctggctggctgtcagtgtcagggtcgtggactagtcggcaggcagctggcagccagaggcagagtcagttcgggaatcgggaggatcggcggcaggtgccgcgccctgaccagcagagcagggcttcccgcgcgagttgcgaccttgtctcgcgtgtctgtgcctccctcggggccatggaatcgccacgtcccaatcgctcgctagtggcaaccactccattaaataaatcaccctccgccgtggccgcttcccatcctccaccccggttataaaaacccgtcgcccgccgtgtcacctcacatttcggaagctagctagctctgccctctgctcggggctccctccttcccagtaacaactaacaagtctacacacaggggacaccacaagtacatcgccaccgacggaggaggaacaacaagaaccccg

SEQ ID NO: 13595 - DNA, 1422 bp, Zea mays
atctggagtacaaaaaaagtacacacacaatatgtacttggcttgttttgcccattgtaaatatgtgtagtctttctgtgttgtaagtcatctgctgctctctgggttcttctttgttgtaagtgcaactgtggggatggatcgaagtatggacccatttaaacttttgtggcatcatagtcttctataaacaaataataaaggcttgccatgtgtaattagtgctacacattttcaccgtttctgtgataatttctgttgattttttttccatattttatttttcttcattacttcctgctatcgtcggcactaatgatacatcattctctgtagcgatagaatatattccctccatcttttattacatgtcatattagtattatcctatttgaccgttggcgcgtgcttgtgggttgtgggtgagttgtttacttctgtgttttgtgtgtgtgttggtcaaagatagtaatgtttgactcaaagacaattctaatgtgacatgtaaaaaaacgaaacggggggagtagtctgggaaaactggtcctatccactcccaaaaccaaacgtccgaagatgagccccattgacaaaatggacttggtcattgtatagtaaaatgcatggatcgtacaatctctccagcagtttactcatatttaaatttcactcagtgaatggtaccatcagcagtttacttatatttaaattttactcagcgaacggtacctccagcaaacagtattttggatgaccatacaagtgaaccaacttttaggagtttacattggtttactgttactgcagaatgagatccatagattctgcaccggggcagcaatgacaatatcggaatgataggcataaataaattagctgtcaaaccattgtggtgttttgatgtttctgtaaccttgtcgctttaggctgagtccagtgcacagcctccctctcgcccctgccacgtcagctctcgcctccactctcgcctctgctgctccagtgcacaggctgcagcaggctacarcctcaggctatagccacatcagcttttctatttcagaattaagtaattcacgcrratttatttcaacgctcagaaaacacacaacataatatttttattgaattaaaaattacaaattgcgtaataattaaaataaaattacatgacgatttaaaaatacataataattaatagaaaattacataaatctaatgattattatgtccccatacatgttcaaccaaatcatttagtagttgtgtatacatcgatgtgttcgtcatctcgttgtccatttgaatcctagctgctaggctcggggttgcattgtagtagatcgacgggccgactgtagaatcaactgtctcatatgtctcgtctaaatcggcatcacgctcgtcatcgatgatcatatt

SEQ ID NO: 13596 - DNA, 356 bp, Zea mays
taccgcttttctttcgacacggaaatgctcaatacataattcaactacaatcgccgcaagcttttttttttgtttgtttgtatatcctgaatatccacacagtttttctttaacaatcttccctccaatttatacaacaacgacctcttcggctcgccaacattaggtccagtccacccctccagccaacccaagtctccatccacaagagctcgagaacctggccacgagcccatgacggcaagaagcggtcatggccggtgatgaggaggaccacctagcagacgcgccgcgggtggtgggcgtcctctccgcgctcctggaacgtgtcgtggagcgcaacgacgcggtggccg

SEQ ID NO: 13597 - DNA, 235 bp, Zea mays
tttatagttagttagtactaatatgaaaaatgagattattctacaaaatttgagaaatgaactgataatacaccatcttattttggaatgagtgatttatcaaaccaaacgcacctaaaatcttagtggaagaccaattgagacaccacacaaatagtgaaatttctcacaccttgaagatgctctggtagtctggtactgtacagtcgcagcggcgaaaggggaatcgcgcgaa

SEQ ID NO: 13598 - DNA, 438 bp, Zea mays
gtactctctctgttttgttttaatgtcgctgaatagtgtaataacaaataaaaagaaatgaagagagtaattattttatagaaggagctatatcgtatcggggactcagggaaacaagggtttattcatataataatcatatctcagatatgcaactgcattccacaggcttctcaaaccatccatctacgtcattctccatgtctcgctatctggttctggaaccatccagtgacggccggcggacgtatcacgtggtcatcataaaccggccggcggccccctccatccgacattgttcccgccgtcttccccaattcgccgccaggccagggtaaaaaaaaaaaagaggaagaaaacctcctgcaattcccattccatcgatccagctccggtccaagccaaagctttcttcgccccaaaccttgttcaactcca

SEQ ID NO: 13599 - DNA, 933 bp, Zea mays
aaaagagataaagtatattttgagggcgtcatctggtttgtcagcagcacgacaccatctgtttcgatgatgcatcattgcacacgtaccgtacggtccatctcatctcaactagagattacaaaaaagagaggaacgtccacgaccacatgcatgctgctcaccatggtgcgttttcaccaaaccaccactgtacgggaacgcccagcaccatatgattgtacttggagtccgatcaacgtgcgattaattagcggcgggacttaataataataataataacatgattaatcactagtagtccaggtagagtaggaggtagaagccctctcgggctttacttccgaggggcaaggcagtctagaaagatttctcgcttccagagctgcatgcactagcactgctagtactagcctatactacacactagccaatgcaaaaatattacagctactaccaattaaagcagcgagctaataaaccttgattagttcaaactcctagctaaagcagcaagagctaacactagcactagtagttacttagtactcttaactgcttaaacagctagcagctacaagaacacgaatcatcatcatcaccggtcgtgatcgacgacccacaattacaccaatggcttcttagtctctgaccaagttagctccccgcttattaattaactaccttagttgtgcggcggccgcggcagaggggccgatcgatcagcccaagctgtagccgccattgccgctgttagcggaggccggcggggcggtgggcaccaccgtggtctccgccccctgcatcatgctctgcagcagcagcccgtcctccgccgaggactcgaagccgccgtgcaggaacggcgccatgccgtcctccccgccgtagccgccgccgccgtagtactgctgctgcagctgcggctgcggc

SEQ ID NO: 13600 - DNA, 850 bp, Zea mays
gccgctggtcacctagagatgcggatcggcctgaatcgtctgccctagctaggcggattttgtgtaacataatgtagcagcatgtaacttgtatccgccacctcgtcgtccttcgtctgttccagtttagaacaatggcattgtccatgactgttcaagtccaagtgctcatgttatatttcatagctgttggttatgacttgccactttgtcctgtacgaaatattgtcatggactttgttctagtgtgtaatgctacatggcaacgtctcaagcaagatgttataagttgtggtaaagacctagttaaaagtcaaatacatcgtagatgcgatacggacgtgaagatcacaaagaaacaaaatattttttatcaccgaaactgaaaaaccgagccgaagtttcggtgtgcgtgttgcaaagtgtactgcgagttgaagtggacaagtgctgcactgttgttaatgttccaccgttcgggtgtgctgattgttaaggcacagatctgggacaccgcaggccaggaaatatgacgagagacgggcgttgacagctaaacactccgtctgttgaatgttgatcccttcaacatttcccctattttaacatttattattattattaaccaatcgaatcaactgcacctcttgaccgcttctactccaccgcctgctgctccgctagtcttcttcaaccttgtgatgcttcagcccccccgcccctggtattgatcgctcagcacaaagcatcgtacttggataggagaaaacaattctagacagtcgtcagagagagagagagagaaaccaaattagagaactgagagatcggggacaaagggggagaggag

SEQ ID NO: 13601 - DNA, 259 bp, Zea mays
gccgctggtcacctagagatgcggatcggcctgaatcgtctgccctagctaggcggattttgtgtaacataatgtagcagcatgtaacttgtatccgccacctcgtcgtccttcgtctgttccagtttagaacaatggcattgtccatgactgttcaagtccaagtgctcatgttatatttcatagctgttggttatgacttgccactttgtcctgtacgaaatattgtcatggactttgttctagtgtgtaatgctac

SEQ ID NO: 13602 - DNA, 1058 bp, Zea mays
acacagattatagcaataacgctaccatcttttgagctatatataagcatatagctatggtatcaatcttatgttataaaccaacacaatataagtattgaactcgagcatctttttgttaatattttacaaataagctactaaggtggcactggaatatcttaactagtactacaacgcggcgcgccgttttctagttcactggtcggtaggattctcggatcaaaataccgacagaactcctttcaaggtttcacctttatcccatggtcggagaaattctttgtaaaattaactcctagaatcagatacaagatggatatccagatttaaaagcgccacgcctatttaagggtatgtttgacaggactctggtttgtcccaacatagatctagctctagttttttttcttctaaaaaagcaggtttttggtagagctgaagccatttcgtaaatcgtttggcataaatgatatatcccagagcaagagccatttccctgtattaaactgccagagccagagctagtgaagttactatttgtttttcttttccgcagtacagaaattagctagcgaacaaatagctagctaagtattaaataatttgctaaatataactaatagctcaattattagttagtctatttaaaagtctttagctgattttagcagctaattattagctctaacatattcaaacactttctatatttaatacttatagttattatttaaatatttgatagggtagaaactaatctacagaaatatgtgtttatacctatcgaaactagaattgctgtgaaggtgtttaaattttatgtcgttctttttttttggcgccagcccgctggcggccgcgccccataccgtgctctgggccgctgcgtgggctgtgtcggtccataggcccagttggcgccgggtcgggttttgctagggtttactgcttgtcttcctttctcggcagtcggcaccttcgcggcttcgcctgatcgcctacgccgcttcgtcctgattctgattctctggtgctcccaagaagaaagtcaggga

SEQ ID NO: 13603 - DNA, 407 bp, Zea mays
ctgagatgccggcgcggagtttgagctcgaaaccctaaaagctataggaacgggatagacaagcggtgtcaaaccccgaaactacgcagaacgaagcgagggggtgtgacaagggagaagctaacggggaagcaacggcatgtctgcggcaatcccgatctgagggaatggatcggccatgcatggcatgagctgtggaggcaggaagggggcggctcccgctgccaccgtatgacgggacagtaaagcatgccagatcggtgaaatccaggagcagggagaggcgcgggggagatgtaccgggcggcgagcggctgcgagcggcggcgcgagaggatctataacctggatttggactcgacaagggcggaagggcgcgggggtggctgttgtatagagagagtggg

SEQ ID NO: 13604 - DNA, 1500 bp, Zea mays
aatcatcggggggctcaggcggaggaggcagcgggatttaaagcgagagatatgactcgtcagcgaggtagggagaggagagaccccccacacgccgcacaggatcattcaatgccccgctgaacatgacagacatgttttcatcagttcttgtctctgattctgacagtgacaggaacggattggtatacataaacacaagttaaaattattttttattcagagatgcggaccattcatacggagtactgctaccaaaaaaggcacaaggaactgggaaaaaaaatcacacagagatcaatcaccctagaggcttggatcgcagcctagctagcattgatgaagaaggcaaggcaaagcccagaggaagccgtctcgtctgccggtttgttgccgcgtcgccgtcgctgcgtcgttgcagcggccgccccatcaaatgcgtctcagcacttcagcagagtgccaaggatccgagtccgaccgatcagttcccccccgcgtgcgtttgcgtttgcttgcacgggttgccgagtcgccgtcgcgtcccgccgccgccgccggtgcagccgaaagcgcctcgccccaccaccgatgcttgcggccgccggctaacggcaactgcacgtacccatcgactggcgcgaggcgccatgcaagaacatggccatgggccatggcccgttcccatcgaggcccaggggccgagcgagacgagacggccacgtcaacggaaccgaattcccccctgtccccagaacggaaagctccccccgctaacctcggcctcagatcaaacgtgcgcgctactccaccaccgcaaatgttatgtaagcgctcacagtctgacggaacgttctgcttggaacggagcggagcggaacaacttccacagcacagcgaacgcgcggttcagttctgctggtaagaatttcgtcaggcggcacaggctcaggcgtcctcagctgcagcagtgattcgtcgatggaacgtaacgatgcagggttagctgggcgcccggcggtcgctgagctcagctcagctgccacgcacgccgccaccaacaacgccaccaccaccggtccaccggcgtgcgtgagcgcgcgagattttgaccgctcccccaacctctccacgcccgtttcgtttccttcctcccttcccttggacgcttacacgctgcccctgcctttcgcggcactccacacgcgcgccacggccgagcgctcccagcctcccactgagacgcggaccctaccggcgtgggggccccgcgtgtcagtcaagcctaccgttaggcgactcgtacgtcctccatcgaggcgggctgccgagctgcgtctacgtctccgtctgcgtgcgcgtccgtgtcctcctccgcccctccgcttagttataacgagaagaagcaacagctgagctgcctcgagcagcagcaacaaacacgcgcggcacggcacggcagcctgactcggaagctacacgcaggccggccgtagcgag

SEQ ID NO: 13605 - DNA, 473 bp, Zea mays
tggctgtccagcgcgctggtgcggattgacaggcaggttgtcctgcccgttcttttttctggtgagtggtgagtgctttggccttttgctgcacttggttggcgttcttatggtttttttttggccccttgcctttcttggtgctagactagagtatgatggtggagccgctgttctgttcttgccatgattgacgatttctctgttaaaagttcaactgctctccggaacattccatccgcttccgttctgatatcagtatcaccttgcgcacttctctgtgaatttgatgacgatgatgatgcatacttgagtgcccagacatgctcctgcaaatccgtccagttcctgcagcttccacgacccgaactctttcagttcttaacctttttctctctaccattttgttgcttcagcgaggtagctgcttgggcagacaagtaggagcagcggctcaaacttcggatctcggc

SEQ ID NO: 13606 - DNA, 145 bp, Zea mays
ggtacgccgaacgcgaccaatcaaccctcacgtacttcctatcctatatatcggcccgccgatcccgctgccttaacttgcatattttcttgacacttgacagccaccacacactagagagagagaaggagaacgcgcgtcgtat

SEQ ID NO: 13607 - DNA, 253 bp, Zea mays
taccgcttttctttcgacacggaaatgctcaatacataattcaactacaatcgccgcaagcttttttttttgtttgtttgtatatcctgaatatccacacagtttttctttaacaatcttccctccaatttatacaacaacgacctcttcggctcgccaacattaggtccagtccacccctccagccaacccaagtctccatccacaagagctcgagaacctggccacgagcccatgacggcaagaagcggtc

SEQ ID NO: 13608 - DNA, 1500 bp, Zea mays
agatcataaataaatatacagagtttgtcccttgattttgttcagttactttattagaacatgtataatgagtgtcttgatacatgtcttcgaatatatttaaagggtaaatataaaaaaactcaagacacgtatcttgataaagattgtgtcttggctctatactcgaaacagtgaactagctaattgatcaattcaatttattgaatattttgattgatgcaataaatatagtaatacacatgttttaaacatgtctactatattatagtgttttagttgtattttatacttggagtaccatgctagtgccagtgctgtatatacctctagatatctcttaagagaccatctattaattaggcttatatgtgccctgagggtggacatgcataacgagtgagcctttcttcacaaagacaaagacttttatcagagttgaatattctcatttgcagatgagaatttaattagggggggggggggggagcaaatgcaaatggcgtagcataatcagtaagacaaaaccggcctacctccgyaagcgtctcaagtcagaactgaaagcaaaacaccattcgattacataactgatgtgcaggagctatatagaaaaatacatgaattttatagagatctgcctagttttaagaaaagaaaaaaaacgaagaaaacagaggggggtacatccaaaagtggcgaggagagagggagacgaaacaaacgagaacaagcaaggtaggcaagaaccaaaacaggcgaggcggcgagggaccagcgtgcaaagcgaaggcgaccaagcaggcaagcctccctgccgaccagcgactggcgtgctgcgtgccggacagacggaggaggaggaaagccgaaagcaccaactccccctctcgagtctcgtctcctccactccactgcactcggcgctccactccacttcctccctcggtcgcttacgcagcttccaacgattccattcccagctccctcctcatcctttccgttcctcccatcccccacccaacccgtttcaaatcgcaccaaaacccccctcgaagacctggagcgaggcctgccccttccgcgctcgcccctgccaggtgtagatcccccattcctgtcgctcgctcgccgccggccggattcctgatccgacgggaggtcttgtgcggaggcgggaggcgctgttgcgtgcctgcctgatcggttcctgcttcctgcgagttggtggtggtgcggcggcggcggcgggttctggcatggggttgcgctgccggggcatttcctcgaccaggcggtgggcggcggcctaagatgcgagggcggctggcccggggagtggggcaccaggtcggggatagcttctcgccgtgcgccagcctccgcctgctcatgctgccggccgcccggggccctcggcgacgggcattggggcgcgctctccccgcgaggtgctgacgctgacgcgcgcgcggcgctactagccgccagccgcccgcc

SEQ ID NO: 13609 - DNA, 1500 bp, Zea mays
gtaaatctccttttgagaaacttgagctatcgtactgatcaaagtgatcattgtcctgtgccaagatagctcggctgtcgccaagattcatgacatatacatcctggtccttcattaacattacaaggacacacgaacccattaatgcaagctctgggtatctatcaagctccttttccacaattttcatgtacgcttcctctgttgtttcaagtgcccgtgacattgccctcaatacagcatcatgttctactggtcccgacttacatctcctagtgacttctgaagattttataacactttcatcaacatgaggttgatctctgtgccaatcatagttccatgggaaaaacttcttctgcaacattttttgctttttgtacatcttcctcaactttgatccgattaaaattcttctcgtaacttgcttgtgccctgatgaagatgtagatatagaacaccctgtacactctttaatacctatgccaagtacactatcagcgtgtcttgaacttccaagaccttcagaatcatcaaaacattctccagttgctgccaatgaacacctggagacctcagctgtgtttcttgagcgcgcttctacagtgtctgcctgtgtaacatgcaagtttggtattttactttcctctggtggctccttagataaccttgtgttataatcttgcagcagttccatctgaagaagctcaaagagacgcttgctttttctgtttcctttcaagaatttggcatgctgatcacaataggaactggtttctgttgcacatctgcagctggtgtttagatctgtacctgaaagatctctgttcgagctgtggggttctctactttggagatcatttcccagatcagcttcaaccatttcctcaactatctcatccctgcccaacatctcactacttgaaccatgtggagccaaatctttctcttcactgctggtacagtttggctgaaattgcaaggcactatcatcacaaccctttccaggtgatacattttgttttccaaaattaccaagttcttgtctcccactgtcactctggcactggccactatcatcatgaggagcatccacagaagcagcaaccaatccaccctcttcatgagtcgatacatgatcactcctttcagagctgtcttcataaacccagagcaatccttccagttctctatcaatggccttgtatagattgctcattaaaaagtcaggcacatcagggccactaaatccatcataaattccaatgaacaaccatccttgctcttcggatagaacaacatgaaccctatcttcccctgcctttccatgtgcccactgaaggttccttgtcacgttatactcaggctcgggtatcccagattccaatccatcctgtgaaccttctgatctggactttgcgtcccttgcccagggcagttgagacataggatgcgacagaaacttttgaacccagcctggattttgtgagctcctgctga

SEQ ID NO: 13610 - DNA, 631 bp, Zea mays
acccaatgggtgtagcccccgaccttcaagtggatttttgaggataatccactcgaaggtcttccttctgtgtcctttttgctgaaaattatcctttctgcttgtaaaaaattggcatgatgtcatccgcgctatgtcatcagtattatgcttcagaggtcagcatgtattttgtcttttgcagccgagttcgcaatccatccatatctcgctaggtagtgtaatttatttgctctgtgactgattggacagttgatggacgttctctgtctagccttcaagtcatttctgtcgaccatattttgcactctactggctatatttggcttccctctaactcttgttgatatctcatttttgtcttgaggtattcactgcatgccctgcacggatgtgaccgtttgaaaaatatactgataattcctgggcgtccccccccccaatgggtgtgggcaagggacggcttggtacgctgagtgttttagccggttgcctctgagtagtaatgcgatgggacggctagtgtaatcatatcctttgcgctgttgactggagtcccaatgggtgtagagttgcatgaaacggcgtccgctgtctgacgtgtcttcgggtgggtggaagtgcttattga

SEQ ID NO: 13611 - DNA, 273 bp, Zea mays
tcttttagagtacggaatttagagttggagacagtctaggactgaaacttgtatggcagacaatcaattccagcccagcgctcgaaatcctccaacgcatgggagcgcaagcaaaccaaacgagtctggctcgctctccatccacccctttcgtgtgtccccccactagaaagtctggaagcgcccgcgcggccccgcgaatattttgaactgagccatccacgcaccgccgccttttgagctcgcggcgagggtttgggcggcgggcgcgac

SEQ ID NO: 13612 - DNA, 659 bp, Zea mays
attttgagttgtgatttcatttagttgtgggctgtaataatttggcctgaagcctcatctatgagtgcgaaagacggacttgttactttatctaaaaacaattagctctaatggttcggaacgggtctaagtaaaacttcactaaaaacaatttatttcataacattgttatgcgattatttaattggtaggcatatgaaactgtacaatagaactatgcattatagatcttattttattatctataaactactctataagttacgattaaaaacagtggatggccaaggcccaaggtgattgagcattgttaccgctataattcgtacaagacggtgagtggggggtggtgacagtgacaatatcgtgcacacatgacacacccgctcagcttgtacgacagcaggtgagatgggccccatctgcccatgaatttctcctttgaataatcctccagatcgctcgatgcatggatccgtgtcaaatgggcggacattactctgatcggatcggaccagcgccacagtgacaagtggaccccacaaggccacaaacacaaaaactacacttcggtgtccctatatgaatatgatccgcatacccccattccccgaaggccgagctcatccaatccagtcgcctgattgcattgggatccc

SEQ ID NO: 13613 - DNA, 411 bp, Zea mays
cggaagtgttggacgtctggtgttcaagaattttatgcactactagggtgttatcttggtcaagcagagcgtggtttgatttctttgctctttgctgtcagccttcttatttgacttgacttcccttcacttctgaaatggatgtcttaatttttcttcctgaactaatggatgtagttgttccacatggcacaagcaatagcctccaaatcaaggctgcaaccttttgtttttcttacttatttgacccaacaagaattcaaacaataatgttacaagtttgacaggaaaaagccccagacccgctcacgtcgccctgcttgggcggctcgggcagcaaattctagccgccgccgccaccttggccgcggcgcttcccgcacgccctgcaaggacggcggtggcagggag

SEQ ID NO: 13614 - DNA, 1500 bp, Zea mays
tccagactgcactcttcttccttccgcttccgccttcgccacctcccccacctctccctccgtctggtcctgcccgcgcctcccctccccccagtccgtcgataaagccgaggcatcgggacggcggcaggtagaaggagcacccattgcttccgcatctcgcgcaggctctccccaccgcactcccacgcctgataccataccattccgccgccgcatcgacttctcctcctctgaacccgcggcgggggcggacggagatccattccagccggacctggatcggcctactccgacaccggcggtaaggaagccaccacctgctccgacggattgctcattctgctccgcgcaatcatgccctgccctccaacgaaaattctttgttttctgtaatgggcggtgatggattcttcagtcagtccatccagtttatcgcggcagaaaaccaccacacaagttcactttgtttcacatccctttttcgtcttttttacagtatctccggttaattaaaaaggtccgctggttaacttcttcagctttttgggaagataaacaagactgcccttcagctgagtgctcggaagaagtgggagggatttcacggttcatatccgtatatatctgcctcgaggacgaggaacccgctgcgagaaaaagggagtggacaggtactgactccccatttcttgtcctatttttttctttttaataataatttgtcactggtcgcttgcaagttgcaacggctcaacaaacgactacaccaaacctgtgcagccttttgttttagcccccacgagttttagctggatagcatgtgtgatctactgatctgtccagttttaacttgagtggttgagttcttctcgagagcgtgtggtatccctttttttttcttttattctgccaccatccacttgccatattttgcaagtggatggttgcaaagctgcaggttttgttcctataatactagcgcatagacatatccgctgcatgttgggaaggatatcacagtatattaaacaccattatacatgtaccactgatccagtagtaccgtgattggattttatgcccctgtgcaactgtgctttcccaaacaacgctttgttgtactggtagcggtgggtcaaggacattaattagtatgctcatgtgtttagattagatgatgcaagcgcatagacatagacatatccgctgcatgttgggaaggatatcacaatatattaaataccattatacatatccagtagtaccgtgcttggattttatgccgctgtgcaactgtgctttcccaaacaacgctttgttgtactggtagcggtgggtcaaacacattaattagtgtgctcatgtgtttattgcgcgccattagattagatgatgcaatcaagcgcacacactgatagggtattctgtactgttcgtacttgtcatgagttgtgatcaagcatttgccgcaggggccccccggctgggtcacgagct

SEQ ID NO: 13615 - DNA, 1500 bp, Zea mays
aagaacagctgcgactgcgtcgcgagcaaccgcggcgggacaacattccgacacggacgacacgacccctctgtagccggcgagctgcctaggcccgctcgtaccgacgtgtgcaccacccatcatttccccgtaccccgagccggcggtcggtctcgtctcggctccctttgcatccaggagggacgggggcaggggctagggcggacagccggccaggcccatctctgtgcgcggcgttttctctgttctcgcaacgctggtgtcaccgtctgggtttttttttttggtcacgcccgcgatgcgacggcgcgccttggagcagtgtctctgaacatggccgggcgccgtcggttcacgggcttacggcatgcaggcaggttgggcgtctgaggtgaacggaggaccggcgtgtgggacgggagactaatggcgatcggtgcctttcgggcgggccccatcacggcagcgatggcgcagatttgcagttaagtcaacaggactagctagctagctagctagtgtatgtgtgtgtgtgtgtctgctctcgaccaagctgatgagggtccgcatccgtccagccggagctcggactcggtagcgttaattggcagctggcatctcaccgatcgtcccctcgaaacccggggcaaaaagcctttaggaccgggatttccacgagcctgcttggtgagctcggtttctttgcgagctttgggttactcgtcgccgacggcaggtgcgcgtacttggctttctgcatcggggaactctcgcgcgatgggcaggtgtgctcctggttcccgactgcgacgtcagtgctgcgcaaaacgcatgcatcggttctcgttcgttcggcgatcggtgggccgccgagggcatgcatgcgatgcgacgagctatagctgcgacctgcccggtttcttgcgactgcacacgtactgcagggttgcattgcacgccttattgttgcggggtcgtcatggcaaaccgagctttttaaaaataaataaataaataaatgcgcgcatctactgaatggtcagatcgtcgtcagaatcattctgctcgactgcgctggtcaagcgggccctagcgcaaaataatcaaggtagcatttgaaaactgttgatccgtacagaaaaatactggcaaatactccatagacatcagggactgattacctgttgttaatcttgctctcaggtacgccaccaaccatacttagcagcgtgagtggctccagagcgacgacagggcccatgccccgtggcagagcgggtcgttgtctccattgccacgcccgctttaaaagggaccacctcgtcgctctccctcctccatgtccacggtcaccgtggcgagggcagccccgccgagcgttagtcacagttgttgcctgcctaccatgcggctctaactcgatccgtgcagcagacgccgagtcgcggcaaggagtagctaggaactaggaaggaggaggcagggaaaggccaggcc

SEQ ID NO: 13616 - DNA, 1500 bp, Zea mays
tttagtggctagtaataagattcatctatcctcctagtctagatatgatggcatgttggcttatttggtttcatcctttcagctcactcagaccagaccttgtttttaacctactcctgcacctactcgagaagagctacatcgacaccttggaagacagttcatgcttgaaaatctcctaagggctgatttggtgattagggatccctaggggatccataattttgaatagcaagaggatttcttcccctcgggattcccggtcaccaaatcagccccaaatcagccctaaggtagggatcccgggaggattggagggaattgagagtaaaatagtttatttcccccttaattccctccaatcctcctgagatcctgggtcaccaaatcagctctacaacgttgaggagttcatccgacaggaggcggaggagagacctaacagcagatcagagccgagcgagggattgcttgactttgcacgagggctcctgcgcattttgctgggctttgcacgagaggcccatcggagcctcgacccatcgaagcctaaacacgcataaccttatattagttagacactgatgcaaagtttgatatatacttgtcacgtagttctctatgtatcaaagggctcatgtatgactcatacatcaatctcaaccatatatacaccatgaaatagagcatatgctttatggatatcaaatacatggaaaccttttaataagctacccacacagcctcatagctaggttattaaaactcaattattcctgagcatgcataatcgttgacagagataatctatattaacaatggttacaaaaaaaaagacatcgctcagcatggcaccaccaggtaaactgagcatgagagatgatcgagcaagccaggcaggcaggcagcagaaacaagtcacacacaataatgcatcggattatgtgatgaagccatgaaggcttctgttgctcaatggtagattgttttgttttttttctcatacaatagtgcacgcacgcgccccatgctgaatcctacagctagtacaagatccgatatccttggtttcttattctcaagcaccaaaggatggcacatggcatgagacgactatatcgattccctattattagcagcctgatcctatttatatttatattttaaaaaaaatcaattgagctggtagttccgtgacaactaagctatatcacatccatttttggtattctctgatccagctctctgcctgcctgcaccccagatgtttgacttgttagcaaaagttttaaaaagctagcatgcagagaacgagctcatacaatattgaatattgcagctagcatgcaccgccagctttctataagatcgccacctcactgatcagggtagtcagtcaccactcaccaggtcttccacttgctcacgcgcgcttgctagctgagctgcacagcacagccgtcagctagccaagcctccgcaccgcgccggccggctggc

SEQ ID NO: 13617 - DNA, 612 bp, Zea mays
tctagctagctagtccgtgtatgtgaacggtgttaggtagtcattggatccgttgactatatttgtaaaggtggtagccgttctttttaattttaacgccgctgggaagaaattaaacgtggtacatctatgtatcgttttcttaacagtgatataataatatactatcattgcatgcgtccgcaattgctctctcgcggctcgttctaccgtgggaagaagagctgacccgtcgccgccccacatgcatacgatgcgtccttatctgtcgcggctcgtgcaaacgcggggcgggctgagcgccccagcccaccacttgcaccacttgcatttacttaattagttcataacacatcacatctgtatcttacattatctttaaaaaaatgattcacacattatttatatatgagatataataagtttccaggaagcatctttggcgacttacgtacgtgtatcagagacatggagtgataaactattgggcaaccatttagcaatcctagctagccagctcgtctataaatagatgcatcagctccacttggtctacacacttcacaagcagctcaaagctctagttctagctagctagcaaagggggggaaa

SEQ ID NO: 13618 - DNA, 926 bp, Zea mays
cccccccccccccccccccccagctgctccctgttgtctccatggagtctagggaatcgtagctcggcaaaatgacaactttcggcagaaacagataaacagcacacggatgatgatgcaacttatgtgcatgactccatccaacaatttgttggtttcctccgcgactccgaaaggtcgctgtgcatgcatttttcttttttgtcatggtcatcaatggacggccggcatatatatacatacatacatagtgattcgtcctccacatcttgtttacccagcaggccaggccagccggatgcatatgcatctatttgattccttttactactgcagaaactgtgcagaccggcatccctccgacgagcttgaggtcctcctctcagcacaaggcagccaccaccaccaccaccatccttcttcttcagtgatccatcctcagctaagctcgctgctaatgatgcaagacctagggttccaatggagcagctgcggcagcttcgtggacacctcctcgtcgcccatgccaccaccactggtgaacggccagcagcacgacggccacaacaagatcaaggagtgggaccgcccgctcactgctaataactcatcaaggtcatcgtgtgcgagcacagctatggcttgccgagatgtcgtcctcgacggcggcggcggcggcggcctccctgccatggccgccgtcgccgccgatcttgacgacggcaccgtgctcccggcgagcgtcaacgtcccccggacgacgacgacgcgccagaggccattcccggcggcgccgccacctctccccggcgacgcgttcgagatactggcttcgtcgaggctatgcaagaccctgctgcttagccaagcttcttcttcggtactgctccataatggcacgacgatgcctttgttgagatcagagc

SEQ ID NO: 13619 - DNA, 324 bp, Zea mays
tgaatatagacattaaaaccaagagctgaaacgactactattttaggacggatgtagtgttttttttttcttctttacttttttaataagcttatgtcccaatggaatgttttgccttcttttaagtttcttgacaaggctactattttgtcacattggtgcatgtaccttttaagtgattactaaaactctacgagactttagtttatttctattaaattttcccatccatacatagtcctcgtagcaactaatgatagttgtgctctgatttgatttcttgtctgagcagaaaaagaggcaccaccaactagaaattgttct

SEQ ID NO: 13620 - DNA, 1500 bp, Zea mays
tcaatcgataagcatgtacattcacgtataccacacctggcccttgatgagatgggatggcagtatggcacacgccgtacccatgcatggacaagcccacgtcgccgccacttttctacggaaagcgccagcacacatgccacgccatttcaccaagcctggacggcacacataggcatggactctagccatgcactccatgcacgcgcagaatgtgtgatggatcggtacgctggatcagaacgcgcgcgtaggtttcctgacttaattcctttgaaagcaaggaactgaaaaggaaaatacccccttcattccatgcatgcataaatcaagcggtcgtcgtcgccgcctgtcctgtcccttggtttgggtggcacagtaacacgcgaactgaccatggtttccagggctggctaggcgcgcttggaccgacgcacacttgtcacttgcattggtcaccatgtaatctgtgttatctatgcacggtttgtgtgtgtgtgtgtgacaacaggcacaaacaggctatatatcgtccagcagatagatgatagatacatcgggtgtctacatgcatacgcagccagggacagccggacagcacaccgcatcggcacaacggcccgcgcgcatgcacgcacgcgtttctcccatgcacctaaaactgaccgagagtagtgaagaacacgacgctccggcgccgcaataatgatcagcaaccagatcacgacgacccacatctatcactggactgcttgtcccagatggatgcctacatctacagcagctttctatcgcgaaggcggccccttgtagctagcggccggccgtcagccgcgcgcgcatgcgcatgtcgacgtgggcggccaccagccgcgcagccctcttgttcatgcagccggcgatcgacggcctgagcagacatgagcggcgcgcgggcggactcacgcatacgtccacaggaatcgcatgccagggctggccgggcagaggcaaaccggaggtagagacattccagaacccggcctccattcggcacctgtcgccagcaccagccgaggccccggcgcgaaagtgagcccggcctgcgcgacgacaagcgtggcacagttggaaagaacaagcgtccaatggccagtagaaacagacagcaccgaaaaagagggccgccgggtatagaggcaggagcaggaggcttcagcggaaagcgccttgcgcgagcacgcttcctgcctatttaacgcgcgcgctgcagcgtgcctgtggctcactgcactaccagaacacaactcgctagctctgcatcatccgtcgttctggtgagcgagcgagcgagtgagagacctagctagactgaccggcggccgccggcaggccgagaacgaagcgtttgtgcatgtatgaaagtttcgatttttatactgtcgtctacgaattgttccttgatataaatggttgttgttagtgcttcatcgatctgatctcagtgaaggagcaggagcc

SEQ ID NO: 13621 - DNA, 388 bp, Zea mays
agaaatttaccaatggtatatgcatcttttactgaaatggtttgttaacatacagcaattcgataaggttcttgagccatgtcttttgcctgagctgtatctgaaaagaaaagacttgccactagaaaaatgtctattgttttaatacaaaatcttatatagtgaccaaagtggtgtctaactgtgaagacatgtatgatctgttgattatcaatatttgtttggtattttctactcaaaaaaagctgttcaggatgttcctttaacatttaatgtgatattaatagctgtgtccgcttccgctattacatatatttgtatttctatcctttaattgcttagccccctcttaacttcgtttcatgatccaccattgtttgttaggctg

SEQ ID NO: 13622 - DNA, 72 bp, Zea mays
tcatggcgagctatcgcgcagcaggcacagcgccctacaacgcccggccgtgcaaactaaccttcggatcag

SEQ ID NO: 13623 - DNA, 1500 bp, Zea mays
tagatagctagtaattagtcctgagatccaaataaacatgccatattttctagctatatatcttacgttggattgcattgcatgtgatgaaagatyttagatgcaatttgcatgtcacgtcacaaggcatgacgctatcaacttttgggttatgggaaggcacgtgagattgcttcaacccaccgtccacggatcgatcaaggtttgcatcccctctactttctttgacataacaatttcttcctataagaagtatacatacacatattgatgagtcataaatattcacttaaaaatatatgtttatataaattatcatcatggacattaaaatcaattttagatactttattagtgtcaatggcgcacatacactcacatttttcatgattgctaaaacataacgtgtatgcttatgtagtacttgatttgcatgatggtactagactacatcatgtatctctactctaataaatcttttacatactaataatattaatagtggaggttttctaaaacaaatcgtatttctacatacggttctttaagaaaaccgcttgaaaaaacaaatcgtatttctacagatggttctttaagaaaaccacctgtaaaaatccataatttatagtggaggttttcttaaggaaccgccagtagaaatacgatttctagtggcggttttcttaaggaaccgccactagaaatcatttttatccttaatttttcgagtttttcaaacgatctcgtatgayaaaaccaccaaaataaaagttgtagatctctaaaagttatgaaactttgtagttgacaacttttttatttraactcatttcagktctcaaaaattgaatctaagtatgtcaaatttaaaattcaaattttgcaaactacctcggatgaaaaaagtgtcaaaataaaagttgtagaacttcaaaagttatttatctttgtagttgataacttttttatttgaattcgtttagggtctcaaataagcaatttacactcaaatagttgtaatatgtggagaaaacaactacaaactagacacaaagcatgtcatagacggagtggttgtggaggatatgcgcgagggtaaggtcgatggttcgattactaacaatcgcgtagcgtgcgaaaaatgccgcgacttgcgacttcgacggagacgggtggggtggtcctaatacaaataatattttttactatttttaaaatatgttttatgtttcctggaaacgatttgcactgacggttttattacgtcgaccgccagtgaaaatcgattttcactggcggtcttcagttacccgcctgtaaaaatggtgatttctactgacctctagcactggcggttacgaaaaacgtcactgtaaatatgtttagtaccgtcagtatagagcttatctgtactagtggtttctgttcgatccggtaggtggttttctgaaaatcttggaatctttctgtaggggagttgatcgagaagcgttggtggac

SEQ ID NO: 13624 - DNA, 1500 bp, Zea mays
gccgtgggttttcagattgttgtggatcttttcaatcaactaacacatccttcgttttcggcgtttgttccgcaattccagccctccttgtttcggcatggatagctgtggtgcgttcagagggagacagacatttgtgcccttccattgtcagccgagttcgtggtttcacgtcttggcatacaatgggcccttctctgatctgttaaaaatcaaaattttcagtgcggacaggagttttgtagagattgccgttccactccagttttcttctcacgctagcaagagaaaactgaacattggattcctagtagctttctttctctgaagcagtttcgtttccctgagctgccaagagcccaagacctctctctctctctctctctctctctctctctctctctctgcaaagagacaaagttattgttagtcatcaccagatttttgggccttagctgcagttctgtatgtttcctatattttttttacttttgacaactgcatagacaactgaatactattactccatccagttccaccaatctatacagtgttcaaggcttatattcgtgctctcttttcactgttaaaatcttcagcggctgatccctgatttcacatatatgatatctctttattgcctttcatgtctgtctatagtttaaggaccccattaatgacggcgaacaaaatgtgcgcattgtactagcacactggtagtttcaaggcgctgtcctcaccctgcatcttacagtgtcctgaactgaatttagttttagttgtcagggtccgtttactgtgaccatcattatgcaagtagcagaaggtaggccccttcatctcttgctgggccaaggatgatagccttcactttcatgcttagttctctttagtaaggagaaaacaatttggttgctaccggacaaatgtgtagcgcagtgtagggcatgttgcagtggggcatttcatttgcaaaggatcatcttttttttttctgatgtcttgtagctttcattctactttagggaatagatagtttcaaggcttggtaagtggccaagtagacgaatttcatcttctcatggttttcgacttgcacatggataacataggctttagttccctgtcgatacatgtagtaagttagtaaccttattgtatatgaccatttcgcatcatcaatgttgtttatgaactctctgaaacttgccaaattgtaggattgtggtccaggtcatctccccgttcgctggcttcagcagcagagctcttgctggcaaacaagtgatctttctacagttttaggtaatttcaacagtgatggatgaacaacaatacctggctgaagctgaaactcttctgtaacattttgtcatttttcttctcacgtttagaagggcaggcctttgacactgggtttgctctcttctcatgttcgaagctcggagattatgacacaagcatgactggtccttgaaaactatacacggctttggagag

SEQ ID NO: 13625 - DNA, 141 bp, Zea mays
acctgcaggatgtgcgtgcgcagcgtcagactgaaattgattacattaccggctacctgctgcggcgcgcccgcgcgcaggggattgcgctgccggaaaatacccgcctgtacgacctgattaaacgcaaggagtcccaat

SEQ ID NO: 13626 - DNA, 267 bp, Zea mays
cgcatatgcatgacccaagacaaacgcaaccatgtaaaaatatttcgggtactacagcaatagtatgtaggaaaaatattcgctcgccactcgccagtgctctggttttcgagttcccgccgtgcccacggctccacacgaattcacccgagcacctgacgcccacgagggccagacgattgcggtctcgcggaggcgcaccgtatcagttcatcacgcaagggaggagggctcacgcgctggtccgctgcccgctggtgatcagcg

SEQ ID NO: 13627 - DNA, 1500 bp, Zea mays
aataattattatgtacattttttttctgttctggctcgcgagcttaacgagccagttcgagctcgttaacgagccgagccgagctgactctgtggctcgttaccttaacgagccgagctgagctggctcgttagcttaacatgtctttttttttccattcactcgttaacacgaacactaccccgacgctgcatggagaaaatgaaacacacctgacctgggcagcgcgccctagcccctaggcaagtgtttcaataaaacaaaaaggtgctccaagtcacgattcataagaaaaacatcgctttcctctgcttaccgaaccctcttttccaatccatcgcgtgtcgacgacgtctgagactaccttcaacggttcccgccagagaccctcccctctacctgtagcggctacagagtactccatttctctacaacggtccacgctacgcctccctctatatggtcgctggcttctggctccctctacagctagagagctccctctgcagctagggacgcgccaaacggcccccttctcttgatatgtgtgcacaccggtatttatcagtggtgaaaaaaatattaatagatgatgaatgtgtatggaaattgatattttatgttcgtagttgggtataaaggaatgatatagggggaaccgctgcagagggaggagatatagaggaagagagtgtgctgatgtggcgctgtagtgggatatagaggtgcaaatttagggggaaccgctgaagatagtctgattccactttccaattccacccacccaaagtctctcccggacaagtgtccgcctttcaaacctcggagtcttctgcaggacagcggcgttccaaaaaagatctcctgcggttcgattttgaaaaataatccctttcgtccgttgatctttatgtcaatccaatcccgttctactactgtacagtctgcactccagtcagaatctgttgggtgggggaaaaaatctgttcttggacagtagctgaccagtgtttatttccccttgcccttgttctgctgagtgctgactgctgactgctgactcacgcatttccagctgctccgttcctgggatctatcctattcctatccattccatagtactggttccgctgaaacctccaccatctccaccaagtccccgaaaaaggccggatcttttcgctcaactggcagtcttctccacacaaaaaaaaaaaaccacgagaaagtttgcagctttcctactagtttgcgctggccgctggcttttatagtgcccgcttccagaaccagtggagtcacccgcccccgccctagctcacacgccaagccccagtacaaacaaagcctacggaatttcccccagctccaattcgcgctgttcgttccctttcagccagtcagtcgccgcctccgctgaactgcaagtccaaactagctagctcactgggcaccgatttcccctaaaattttcgctgcttccaggaggccgcggcgacc

SEQ ID NO: 13628 - DNA, 1500 bp, Zea mays
ggggctcggtggccccggccatccatcccctgcgaatctcggtgagtccacgacttcctttccctctgctctcctcatcatgctccctgtgcctcactgaatcctgcgcccggcgcagtggtcgtggcgctgagcctggcggcgcggtgcgtggacgccgcgaggcacgtgcggccgagccttctcgctggctggctgcctttctcggagttggacctggaccctccgtgggtttaaggaatagttgctagaggctagagcagggacagaaggcagagagtgtctccattagaccgtgtaacgctgaactgtagatgggatctgctggagatagcctcagtcttttttttttccgaaaggagatagcctcagtcttttttcacgaaaacaggggagaacagatggaaaggcgatggtctgaacctccgctttggatctgttgggcagtgggctgctggagttatgtaaggaatatggatgcatcagcaggagatgccttcagctagattttaattttttttcttacttctttctataggaacagccatgatcatgatggctgatgatcagctgagatgagatagtcacgatctggaaggggtcctggattcctctccaaacgttttagggcattattgagtgaattcttgctcttgaaatttaaatgccgtgataaaaagagtagcgtatcctactagctccctctacctgttctactatgaaaagttgctttataaaatgttttctaaaacagtttcatccaatgaacaaaaatatctctctctactcaaatctataaactgcagctgatgtgttggagcagagctacatgtttctttttcttttctagaaccataagtatttttgcacatgtgccaagcttcttgtggctcatttaaataaaaatatctctctctactcaagtctacattgcatagtagcttttagtatgtctccagcacgattactatcacttttagaaaccccacaaaaattttagggcctttggctgctttcatctttgttgcttgaaacagattttttgtcacctgaggttcgtcaacaacttgtctgcaagtattaaaaaatcatcacgcaattcttttgaaacagaatgtttcaaaggaacaaacgtggcctttcgagagatacgacttgcattttcgaagtttcattattatctattatttgttgcttcacagtagaaacatcgttttgtatatgttgtctcacattctcatccaatgaacagatccgccctcaaagggagtcaagcctcctccagcctttcctttcaaatcggatttgtttgctcaagttgcaaggtacagattccctaacacattgcatatatacagatcagttcgattgttgcttgcttgagattatttccacaaacaatgaacttatatgtacttgtgaatacatagcataatgatgtgattccagattcattatgatgtgccatatgttttttttgtatttgatgcttaaatgtag

SEQ ID NO: 13629 - DNA, 591 bp, Zea mays
ggtatatatcactagtacatacttggtcagtatgtgaaaaatacaagtgcgagtgttatattcttccaagttttttttttttgcttgtaaactgtgaccctagagaatcctcatatacagttccatcctcatgtttttgaaaataatccttatggtttttcagatttcttcatataatatggcaaattctgtatgttgtcgactcgtgagtcatgagaggagagagagattccgatgttcccagggccctcatacttgaacacagacatggattctcatccaaaactatccagtctctaacctgcaatcgaccataagaatcatttttatagaagaaccaaatctaactatatatatatgtttcatttgcatatatgataacaataacataacatgtttagcaaatgctatcaagaatagaatccagcattccaacatcttttccagcctataaaaaggcagtcctccccatggccagtagcacgaaaccacatcaacttcgaagccatttcagcacccaaaggagagggcaccagcaagaagcctctagaaccttccggtaaacaagcagcagcagagcagaggatggca

SEQ ID NO: 13630 - DNA, 1500 bp, Zea mays
agaagggcggcatagacgaagacggcgacacagtcgatgcaattgtagaggaagaagcttatgccgagggtgatgctgttgaaccgccgtgaacgaggcatgctctaggtttgccacgcctgtaaacacgtcatagacgaatgcatgtgttggtgttgccaataccggaagtattaggtagaaagccccaaccaagtgtcagcgtctgaagggaccaacagagaaggcctcaatgacggtcgtagtgtgcaaaagaacggcaaggaagaaggttttgatgcagcccgctgttgtcggagtgaacaaagtaggcgacgaaaaaatggtgacgctggcgatgaggttgtgctggacgaaggcaaagaggtagtcgcggtaacaaatcaaggttcctagagttgccgcggcgacaaatccatggtgcatagaaagaagatcctcgacagcgccactgtagcgcggcagcagtgcttaaaggaggcgaagaactcgaacaactagaaaagaccatgcacgagagacatgcacctagggctggaaacgagccgagagctcgtctcggctcggtgtagctcgttggtagaccgagcccgcctcgttcactcaacgagctgaaagaggaggctcggctcggctcggctcgaagttggctcgcgagccagctcggctcgcgagctggaccttgataaataatattgcattatatagtgatttaatagtatacaaatgtgaaaaatataatcatcattcaacattataacattataagtaatataaattataaattgccgtatatatcatcagaggataaaaacaagtcgcatatctataaaattaaccaatatcaattattattctataggttgattaaattggtacaactcgcgagtcagaacggctctgcttgttggaccaatgagctcgaaaatcaaactcgtctcggctcgctcgaggttcgcgaaccgctataaactcgagccagctcgtgagcctcaataactctaatcccatctatgctatgagaataaccggacaaaatcctaataagataacaattcataggaaaagtaaataggaaaaataaacctgaatttaaaaagaatgagaaaaaattaaattaaaatgaaaacgagaggagaaaagaaagacgataggggaagagggatggcgtgagccaggcgggagcgaggtcgtgtttgaccacctcctcttccgcggccccgtcgctgggcttggctttaccagtggcgggttcccacacgggggctagacgccgccaccgctgaccccgtctacaccgaatccccgcgcgatttaacccctcgcctcgctcgccgcctccgcttccatacaaccgcgcactccaaacgcgcacgcgctgttcgttcctcggccgctctgtccacccccgtccttctccgcccccaacagatctccgccggccgtgcggttccttaattcgccttctccgggactgtcggatctccgcggcggctgggg

SEQ ID NO: 13631 - DNA, 70 bp, Zea mays
agtaagtaaatatctttggtgtgtctatgtggatcaaaagtaagtatatgtgctatataccatcttgcta

SEQ ID NO: 13632 - DNA, 1500 bp, Zea mays
tcattatttcctcatattttccgggaaatatgggctgtaaatgtttatatgcttttcttttttattattattacagctctttgaagcagcaaccaagagcacaggggcacgcacagtcacagcctcacagggcagggcgcagacagacacagaacggcaaagtccaggacaagacgcactttccagctcctttgtggctttgtccacgacggtcgacgggaaccacctgaaacctgatttggtgatccaccagggatcacggaggaccgggagagcgtgtcgaggggaaaattagtttaattttttttgttaatctcttctaatatctgtgatcactctgtcaccaaataaaccgaatcgagaatttttttttaaaaaaaaccgtcccacaacgggacagtcgatgaagcggtgggcaatcctgaaacccacaccgtaaccccatctgcactgcactgcagcgtactgtagtagtaaacaaaagcctgcgaatctctgtgcgcgcggccccatatctccagaacttgtattaatgcgcctcaattactccaccctccttccgctcacgcgactgcgtccacggtccaacacgcatctcatcggccgtttgcgtaaactgaaagtgtgtgtttctcctccatcttctcttccgtccggaggcgattttgcaggcttgtttcccgttccttctctaccgcgtttgggcttgcggtccttttgcacttttctgctctacggcaggactagcagcatcctgttgacctggccgactactgacagatcagatcagatcagcctcaggctcctcagacggacggcgttgtcttcttccccaccccgcagccttttttgcttgcagcttactagtataattattatggcgtcctctgtctctgcgtgaccgtgtccctgttggcctgttctccccacccccaaacgaatcctcctcccccacggaaacagagagaggacgacgattcttcttaatgatcctactagttaagagcactcaaatcctccacatgtagacgagggacggtgaagacataatagtagaacctgccccacctgcctccgtcgtcaagtcgaaggagacgagccgcgccgctcctgctactcccactctccccagcccccactgcctgtgcctctgtctgcaacagcaacccacatccacctcctcctcctctggtcctctcccctcccgcgctcccgcactcctctgtgctgttctgtgaccacccgggcattaactgcccgcattgggtggtttcctggggcggggtggttggattaggtcgctttgctgctgcccgcccgaaagcagggttgcaaagcccacctccgccctttcgggcagaaagaagccaagaaaaaagaaaagagaggttcggggccaagggagcaaaccccccacacccatggcctgactgacctccggactctccctgcttccgtccacgccgcgggccgcccagctgactgctcctgccctccgcc

SEQ ID NO: 13633 - DNA, 304 bp, Zea mays
gcgcaccatagaaatgaggcagaaagtctctgcatatggtgcgttgattgacgttaacgcgtacgcagcagcctggaccgctgaaccgctggctatactaaccagctgttaaatcgatgtaaagcagacccacccggccgccatgcaggataaccttcttgccgctttgcttgtctgacggtgatagcacgcgtccgtgagctggctggtatttacgctgccggtgcgtttttttgccggggacttgcgcctttcgctatccacgtccacctttatactctcactcttcgcaaatggaccaatg

SEQ ID NO: 13634 - DNA, 1500 bp, Zea mays
gttgttgtctggtcatccttttttttatttaagacaaagttgattcagagttggttcctgacataacctattgtggtcctccgcataattctcagcctggatgtcctaaaaggacttaacatgttagcattatcttttgaaagccttttattgtgacatggtttatgaatagctttagttggttggcgcttcttttcttgaaggatggaaagatatggctcctgcgctttggactgtcccatggaatcttcgtgtcgtgctgactgctgagtgtcttctactttttttttcttaatcaaattagtcactgcattatggaagtatgtagagttagagggaacattcactacaaatgtgctttaactgttgcatttttgtgtagctgagttaatgttcgaagcaactgatattcaaattaagcggttggagaactaaagggcaaagtaaatgaaggcttcacagaagaatcctccataaaaggtgaggctatttgggccctttagttcttcatttttcaacttgaaagtgttagactgtgtgtgtgagtgtgtgtgtgggccggcaccatttttcaacttcaaaagatgacctgttcgtttccttaagtatcatcatttttattgatttatttgaattgtttgataatctcatgttacgtatcaggtgtcacagctagattaggggggcattctatttgctgtatttatggttcacagtggcagcatgggccaatgctaatgaatgaaactgaaatccttggtgcccccatttattttgatgttggcttgatgttcatggtcttgaagtttgatacattaggtagaagtaatgcactctaaatcatcagaattttattaccttgagacattaaaaaacataaaaaagcaaagtagtacataaaaaagcagtgtcacgatacaggtactctttgcttttaaactctagtctctaggtacctttatattataatatcttatcttagagagtagagaaccttaaacatcccaccattttttttcaactaaattaaaccaggatttaaacccctgccagctaggcacaaatttcctccctagccagtgtaactagcggagtacacgaaacctgaaacctgactgtgcgggatgtgccactaacaacgcagcacctgcagccacgtattgtgctgcaaccattaatggacacatatttcactgaaaattttcagtgactagcccttttctggtgagaatggggagtcaaactcctgaccttaggttgcacttctgcattccccaccactgtgctatacacaatgagtgatctatttacagcaagtgtttcctgtcaattactttttccttttattttatcgtagttcagccatagtttcatattatttttaactagtgagttaatgctatacatggtataaggaaatctctaattgaattcttttcctttgttaagtacttgtttatctacagatacaatagttttcttgtctgtcatttcaggccc

SEQ ID NO: 13635 - DNA, 1500 bp, Zea mays
aaacctaccttagaaaccctaaatggaaaattaaataaaggaaaatgaataatgtgaaataatgatttccaaaaccttgtactctgtccactagagtgtatcaagacaatacaaattctactgtgttatcctaaagccaaacctaagcttaaagggtaataagtcaaagtctatgtataccactagaagccccacagaaccaggaaaccctaagttaattcttaacttagtttctttaacttaatgttcttaaatcttgcataatcatgacatacatgttcattgcatttcgatagactgtaatcttgcggacggagagtacatcctcgtgccggagcaaggagctgctcaggaggttgcccccgatccagcaccagagcccagcaccagaggacctgcctgccactgctttggaaggcaagccccggttttatgcataacctgttatttatgctattttacttcacttaatgattgtaggattgattgtgcacttaggtgtaggaattgtttgaaaccctagttgcatgatctcaggaatccttttgaaatgaatactagtatgacaggtcgagtagttgctttaattaaataggatctcggtagaagacgagtgatttttctagcactcgcgcgagatcaggaaattgattgtacccactttcacactatcatgatactagttggtggacaacaatccatggggattggttgtttacgagatggaaaatggaataaggattaacgtgcggatacctgtgtcaagcgtttgaatgtactaaacacataccgagaaatatggtaaatcggtaagcctagtacctgagtgaacctgcccgcagattgccctcctcacgcgacctgagacgaggtctcccattccggttatggtgggtacaagtgcggtcactgcacgacggccagtcggggtcagtgaggcattgtacgccaaggcggtgagcccctttctgttgccagggaatcgatggggacggttgatgtgtgtggggacggagtgcccctgcatgtcgtgtgtttaggtttaccttgcaaggataaaaactcgattcgaatcgtctgcttctcgcagctaatgagactgcttgatccattgtactgcattgagtaataagtggaagtacgatgagttgagataagatgttgattgttaataatgcttgctaccatgtatgagtagatagtccacttttagccttaagagagtcacacttaactttgattaagttaaaatcttgatttagaaactcagctagtgcttttggcaaccaaaccccacagccaaacagctgcatgtctagaggtagaggagtagactcctcacaccgggtaagtctagctgagtattagtatactcagccttgcttgtggcataattttttacaggttctctggaggagatggttgctgggataacttggccgaccaccctgccaccgggttggactgtcgagtgggaccctgcctcggctgaggaggagc

SEQ ID NO: 13636 - DNA, 375 bp, Zea mays
gattatcccgtacccgccttctatcgggtaaaacccgtcgggtattcagattcgggtatccattgccatgtgagcatacacatacgttgtactctcgtcagcgggctacattcgagcccagtactgacggacttgagtttcaatacagcccgctcagagcccagctggcgcccctcgccgcctctctgagatccaacccagctttcctccctcgcacccaacccgcatccgcattcctcgccgcgccgccgctctaaacctcagagcctcaaaccgtcagaactcagaagtaaacccctcctagtctgtcgtctctcttcgcacgccgccaccgagaggacgaaggagcgcgcacgcgcgtgacagagtggtaag

SEQ ID NO: 13637 - DNA, 608 bp, Zea mays
aagtatgattggcacagaatcacaactagtgctatttcagtagcacttctactaccacattatggttgcgtcactgtagacataagttacacaattcaatatgagatgtaatgatgtggaggatactttaggccttgtttcgatctcaagttttatgaaaactggatttcttaaagtcagtgtcaatttgttatttagaaaaccattttgtttgacatgaagataagcaaacatgctttctagtaaattcaaaattccaagttttagcaaaatctactgtgctcatttctatggccagaattcttcacactaccattcattcaatcattcacataactaactcagctttgatggtgaggatartttgcatggtgactaacactgtcagttgtgtaacataaaacatgttgagcactttcaatccgaaaacataaatgtataaaccaacaatgacatagtatctactttagacttgttttctctctctctaaatttcctaacagaaaatgttctctgagaactggtttctaatcttgaaatccatgcaacaatttactgtctgtattcttgaatggtttgttgtctgactcctattttattcagttacc

SEQ ID NO: 13638 - DNA, 242 bp, Zea mays
cggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcgg

SEQ ID NO: 13639 - DNA, 165 bp, Zea mays
tgcagttgcgcaaccaaacaaaactgttcaggacaatcccatatgcactagtgatagatagtatcgtagtgtcacataaataagattcaaagagttttatttatttcgaagaggtgagtgagcaaagcaagtgagccatttgcacaggccggcagatcgctcgcc

SEQ ID NO: 13640 - DNA, 732 bp, Zea mays
tgcattaattttatagccatgacggataataagtatggtaggtgtgatagatcatttctgttctcttgtgtatatgggtctggactttgtgcctacaggatgttttgcccgttgtcatccctaatggttgtcatgcaagctttgatgttgttttaggaattatttagaaattacaataaatttatcccaataattcaaacatgatggaatgagcaatcaaaacattcgtgctgtcaacacaccatcgtttatcatcaaccattaccatctggagctagccattccacaaatgctcggcttgtgtttcaagtgcgagaagccacgaatgcgtccatgtccatgcatgcacgcgcaaagggcaactgccgaacaagccgctctcctgtcccaccgcgcgcccgtacgtccagccggcgaggagcgagcggctacgcgtgctgcacccccgcgcggatcacggcaggacgcacgcccgcctccccaccgcgcgctataagaccccgccgaggaccgaccacaagctctccactgcgccggctccctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaa

SEQ ID NO: 13641 - DNA, 1500 bp, Zea mays
tattcttgatccaataaacgatagtaagatgaatgaaacctttgtcactcacaaacaagagacctttctagctttcctaacagaggggagcaccggcccggtggaaaagcaagagaaaaattgacttcttcaaaaggagaccactatcttcggcaaatcaaatatagatcgagtcatgaagcaggctcactacctggaaagcgtagatcggcaccggcaactcaaatgaatatcccctcccctgtgggatcgagtttctagggcttgcttgacttgaggaaaccactatctatgacgactcaaccgacaagctcacttgctttcgatcgagatggatttccagggcagggcctattcccttaacttacaagaaaatgcgtattacaatgatgtgatgatttaggttctctggcgtattgtgcatgccatgattgaggaatcaacgatccatcgaggcgaggctatctatatagtactggaataggggcaagcccggcacacttaaagccattccaacaatcttattcgtcgtaagcccttctagcaggagctgagtaaaggtccgctcaaggccatggaaaggcagatagtacttgatacaggacgagcccagtctctatctagtacgatattctggtatgtttcactgaattggcatttctagataccaaacaagtaaaaaacagcaagttagttagctcagttggcataggcgaaaaaaagaaaaggaatcaacgataaatcggggaaagagccgcaagcgcgatatcatctctatataggaaaaatggatttttcttattttataaagttatgggaccctggctttaaaatctttcttttttctcggctcgaaagagaaaaatcaaagtcaggtagccgacgaaaaccgaaatagcacagatacaaagtaaagaaagtatacacgcgataatagatagatatatattatatataatgttagaaggagctaaatcaataggtgccggagctgaactcgtattcagagatggaggaaatcaagtctcatgttgctcctcagaaaatgcgtatagtatatagtaatagtaatagtaatagtaatagtaatagtaatctcattggcccactagataaggatgggacaaacgctctagtgtatgcgaaacgagcattgcgttttgtccgagaagttcgtgaaagagtgctcgttacatcaaaagagatggcgatgatctgtcaaatcgacattgtgtcggtgttcagtctcccgctcctgttctcaactatactatggctttcgttactatactatggctttcgttgggtagagcacgggagaataaagtctatagtgtatgcgttactgtactgggaagctagcatttttgcttgtcatggaatcaagtctatttgttcgaatgttctttttttcgtttcgttggaaaaaccaacgccgacgattcgtcaagaatggatcagtctagtctcctttctcttttgggagcagagctgaaaaag

SEQ ID NO: 13642 - DNA, 88 bp, Zea mays
aagaaatattacttgtctttatgcatttagatgaagccataggatcgtccaataatgagtcaagtcgtagggatgcttcagtgatcat

SEQ ID NO: 13643 - DNA, 581 bp, Zea mays
tctctttcgtagggaagaaaaaaaaaccattagctttccgtcccggccgggcatcgtaaatgtggatggatccacgcacgatatgacacggctgcccgttggcgccactttacccgtctgtccgcctcataaattcaacgtgttggtgagaaaacacgaaacagacgagataacgcaacggctttcattcaccttacctggcgcggcgtacagcgacctcatcagctcagcttggggctaaacaagcgacaggtatcgctgctagctaggcgctactcgaacggtgctctcccgtggtcactggagcaccgcatagacatcgctctctagaagtaatggccactcaagttagctgcgactgcgaggagaggatgacttgctgcactactgcaattatacaccgtcacctcgcgcgtcgtggccctggcctgcaaatgcaatgcaatgtcatgaccaacctcgcgcgcgtatattaactccacctcgccgccccactccactgccaagcaactcgcacgcagcagtacgacgtctctcctctgggtctggggccgagacaccgagcacgtactaccagcaag

SEQ ID NO: 13644 - DNA, 988 bp, Zea mays
ttagcaatctgctgacgtgccaccaccataataatatcatgtcaaaccgcttcaggtgcgcatcaatctaaccatggttagaaatctcgagcggtaaccgacgaaattcggtattttttctcgttctcgtcgtacagcggccggtggcaaatttcaagaattccgtttaaattttttaaattttaaaaatcataaaaatctagaaaaaaatgtataaaaaactagatattttggtaagtccaaaatatatttttattcaaaaattcatattttagtattaaaataaatttaatttattctagacccgtggatccgaacctagaccgttaagcggcggttctcggcaagatataaccaaaaaccgatcgagaacggcggttttcagcgagaaaaacgaaaaccaggattttaatttttgaaaaatacaataacggtttttggacgatgaaccaggttttcagaaagaaatatacttttgaaaacaatttcgtttccggcgttgagcgcaaaatattttgaaaacgggacgatgaaccctggtctgacaaataccacgagttacatttaaaaataatcgttttttatttttaaaatttaaaatacgtttttttcgcaggtgaccatcgccaccagcccaccaacccaccaccacaagcacaagcccgcagcattaccacactctccccgccactcgcctcctctgagctgcctgcttgttcgagctcccacggctccagtgtccccgacacatcagccgctccctccactcgccttcctttttgacgttccaggatcatccatggcatccaaaccaagtagggaagactagcatcgaacccgctcgtcacaggatccaaccgcctaagaaacaaagcagccgtggcgacctcctagaggagtcaaccaggaacaagaaggcatcaagcatgttgccgtaggtgggagggggagggcaagggcgcaaaaatggcaacaaccatggccggcg

SEQ ID NO: 13645 - DNA, 255 bp, Zea mays
ggtggcgactgctgctcatctctggccattcgtcggcctggtcgtccgcctgaagcccgcctggagcctgtctgcctacccaaccagagtacccggtgctgctgtcgatccagcgcccttactggtaatccactaatccgcccttaccatgtgaatttggtgctttgtaatggtgaatgacatgatatatttacatatccttatgttttacgaaactagcaataaaggaaaaaggtgaagtagattaataacacc

SEQ ID NO: 13646 - DNA, 433 bp, Zea mays
gctgcactttccctgatctttcctcgagctcgataaacaaatatcgacgcgcagcgtgcctcccgctaactaaacgatctccacagctcctcatccttctgcgttgccgccctcgctgtaccctgctgcttacccttcaagcctgccgaccatcgcatcatcactagctttttttccttcacttgtggtcggcttctcttgtttgctgttggctgttggcttcataagcgcaaggaaggacgagagatagagcgacgaagtatcttgctcggaactctcccacagctgggctctgagatgagtaatgggttctgaggatagagccgcgcgagcttcctcccgttctgcgtccctgcgacgtatgggcactgcccgggggctatgacctgtaaccaaagaagagggaaaatgcgagataagcagcggctggacc

SEQ ID NO: 13647 - DNA, 853 bp, Zea mays
gttggtttcggtcaataatattattggatgagttagatttaatttgctttcttatattttaggttatattttagggtgagtgtgggatggatatcaaagttattatatttaggtatgggtgggaatgggttgaatttttttgccattaggcctatgtacccccgtcctgcgtggcgtgataaacatgtacccccactctgaatttgccagactcgtgcctcgcgtgcggcgtgcccctggaatagccgtgaaccgtgtcgtttccaagtgcattgcatctgcccaactcgcagcaagccgccgctaggtcgtcggggtcccagaatgctccataattccaattgagggtgtcaggtaattagagctgtaaattaactaagatctaagttgtaaaatagtgttttgcatgaccatatatatatgatctaaacacaactatatgcataatttggtagatacagtttaatatggtgttacgctgcggttaaggtttgtttcttttctcccatgtgaaatgaaatggagtggatttagtgagattgaagtggccgatagttttttttcacagctaattcgtatgtattttaagatggtatgattttgtccaaagccccggcctgtctaataccgacagtgtccctttggccctgtctcgcgtctatatatgacaacccgtcggctctaaaactaagccatcacaccaaagatcatccatggctagttctctacttcagcagctgctgtctctctgctgctgctcctgctgccctctcctcttcgtctccgggagcatctatcaggaaacaatgctgtcagcgccaacaacttccaccccatctttctggtagctggg

SEQ ID NO: 13648 - DNA, 274 bp, Zea mays
ggttgccgccgttaaaccctaccgctgctctcgtcaccatctctccgactcacccctctgtcctcgcaagccgccgccggccaagtcctgtccctctcccttgtctggttcggatcgtcgttgctagccaggtaaatctgactgattcttctccttacctgcttctcccggtgtggatctcggctctcgacgagtttcagaggggttgttcgtaacatctgctaagatccgtggcggctgtttaggtgctggatccgtagcggcggcggcggcc

SEQ ID NO: 13649 - DNA, 106 bp, Zea mays
gtgcgtgtgcagctctaggctgcagctttcatcattggcgatcgatcgtaacaatgcaaggttgtgttgtatataactcttgtgtttggaatgccgcccgtaatta

SEQ ID NO: 13650 - DNA, 382 bp, Zea mays
atgatcagtgtccaccgaacgatcaagcaatagtatcaggtagtgggtaatcctggaaccagagagagagagatagagagagagagagagagagagagagagagagagagagagagagagtttcctctgcttggtttagagattagaagcatttcgttcatgcacgcttgcaacgtggccagactgttacatctgctcgcccttttatttatttatttatcacaagcagcacgaacatctttgtccctttctttcttgattgttattcctgacgatgcagttccggacttcccgttgcctcgaaatccacagctgtagctgaccgaaggcattcttgggagtacactagcgacttaccgagccgagcaagcgctagctctcc

SEQ ID NO: 13651 - DNA, 923 bp, Zea mays
agaactactggagttgctcttacttagcccgaccctaaattttaaactatgtggtatctttgttaggtccaaatccagctcgtatatttgaccctataaaatcaaaatattataatcacataaagtttatagcttattaataaagatattaaataatactatcatcatttgatcatataaactccaaatatcacaacaatataaagtaggtagcttattaaattaaataacttggcttcattgagcattgccgacccaagctcggtccatctgtgcggaccagggggccgacaagccaaatttttaggctcggccagaccgtcttcaaatcatgctaggccggtctatattattttgtaccggatcgtgttttgagtcctgtgcgtttttggaccgtgcttgagttggtctaaaaaaacctgacccatatcccagcactactggacaggagactaggaaggataagggaggttttccttgctggaaatcagaacaatcatcgttcgtatgttcttgactgtccgatcgtatctgtatggccaagacgagtaaagctgatactgtccgactggcagtgagctatacttggcagtgagcagggtggcctcccattgcattcccctccccctcctgttgtcccgtacgatggcacgctcggtagccgttgcaacgattggggatcgtctaatatagccgttgtcctgcagcgccttccctccccggccaccgcctcgcccaacggctctattccgtgctccacgctccacggtgaccgttgtgagtttaaagcctccctctcacctcccgtcccccggcccccggtcgctcttccttttccccgccgattcgttccaccaccgcaaacatctatcccagtagccctacacggagagagctgcaaaggcaatccagtgatcggcact

SEQ ID NO: 13652 - DNA, 1500 bp, Zea mays
cgcgtgttttgggtggaaaaaatcgcaagactgactgggtctcggggattcagtgcgtttagaatcgtcgtcagtaatactggagtagaactttacggattatcgcgtcagtcaaacagaggggaaaaggaagaagatgacttgttcgtcccaaacaagagcaggtgcaggcgtgcagcgcagcacagactaatataagaatcgtctgtgaattcatttggcatggagagacctaggaggagaaacgagcgaaaacagatcccggcttgcagttgcagtacatggcatggcgcgttcatcgaactgtgtgtgatcttggcgtcttgtgcagcagcagtggctcagtcagctgtggtgtcaccagttggggtcattcatggagtccgtttgttgtgcatcgcgggtggccggaagatctgtacgcttatgagttgccccgtttgttggctgctttgaatttttttttatagctgcagttactcggcgtgcttgcgctacgatccacatccactgatctggaatctttctatgagcaaacgaagcggcggggagggggaggggccggaggtacacgcggactcgcggagacagatcaaaggaaagcgacacgccattccgtttctgcgatgatttttttgcatcctcactcgccgtcgccggccgtcgaggcgccgagtcggtgaaaagggcaggcaaacgagctccgaaaaggtcgcgccggaacccttccgtccactccggccgccagccgagagtgcgtgcgtagtgtgccactagtccactaccgcgtgcccccacgctgcccccttcgtttgtgggcgtccggcgcgaaccgacggggtcagagctagcggctgcacgggaacgggaacggtagccacacgctcacggcccaccccagcccaaccacagcgtaaaagggcacgtcttttttagtcaactccccgccgcggaagaccaagcccgcacgaaggaaaggcacaccgcgccccggtcacgcgcccacgcccacccgtgcaggtcgactgcaaggttgagggttcagaacgatcatgatggacagctcaataacctagttcgatatggatggagactagcagtaacattttactcaacacattctgaattgtgttagcttcgatgatgcacgaaagggaggggaggagatgaacgaccaacatggttatttcagcacgtgtttggttgcgaaacagatcagaggaatgagatgagcccttgtttaaaagatgaaaagcaataggttcgtccatttacatttatttgtaaattttgaatttcctgcataatttaaggtagaacaaagcttgtttttttgtggtctgttatttcacaaatcttttattgtctccgctttcttacctaatatacgtagtgttatggatccgccttctgtcttcaagtgacaaactgaaactgaccatgaagccatgaaacaggctccgctccggcctgtagccgtgaccccccacgaaaacccta

SEQ ID NO: 13653 - DNA, 1285 bp, Zea mays
ggctttggcccaataggctatctatctaacattaaggactagccgtgccctttactctgagaattagtagaaggacgttccataaacaggggtacagtcagcacagcatattcagaatgatagttgcagcttaataaatttgtggttaaaatgcacaagtggctaagttagagcaactccaagaggccctttatattcttcctaattgatataaatagaggtttttgtaaaaaaaatacaatacaatagcttatctaaatggctatccaaatacagccattttgtattccaagtttctcactggccaaatatagaaaacgtgaatgactctagaatgcaaacaagatatagaaaagctgattgaaattgaaaagatatagaaagtaatttttatgcaaatgactcttcaaatgataatttagagagcgaaaactagaatgactcttggagatgctcttagctcatgaaaccaatgttttcaagtcagatgacttgctggacgttctggatgaccgacttggccgattaatcgcgattaatcatggttagccggatgacttgagtgattaatcgtgattggtcccaactgacttggacgattaatcggatgacttgaaaacaatgcatgaaactgttcctaaagaccatcacgagggtttcaagtaggcatgaaaacgaatacttagggcttgttcgtttcgccgttaatccatgtggattgggtggtattaagccggtttaattccatagcaagtcaaaatacatcccaatccatcccaatacacaccaatacacatggaattgaaataaccgaacaaggccttaaatggcttggtttgcatccgcccatgcaaaccaacttgattttaattcacttagttctctaaagaccccttaataaatgtctcatttaattaggttatacatatcccaagtctctaaaaatctttgaagagacgtcttatttaattaggttgcacatgttctaattgcgggtgggaagcccaatcaaatggcccatcaacacagcttcttaatttccgcctccagttcaagtgttgatggtgattggggcagccaactcaggagaagacggggcgtggagcgtgccaacgggttacccccggtcccaacaaaaactgaccgctactcggcgtaggctaaccaaaccaaaccccaccaggccacccaagcgcaaagcgctagcgatcgaactcgagcccaatccagcggaaacccccaaccctagctcccgactcgagccgatcgaccccgatccgatcta

SEQ ID NO: 13654 - DNA, 1500 bp, Zea mays
agattaacgcaatatatttgcctaacattcagaattctatattgattctttaaaaataatttttgtgatactataatgtttgttcgacatcagttcattctatttagtcaacatatttataataatattacatatttatatcgtcaatataatattaatattatactgatattttgtcatacagattttatatattataatgatacttatcgttctatttttatgttttatattagtttttaactctaagactttgctttaagatgtcgtgaaaatgacatggtactttatgcgtataatatcagatgcgactatacaaagcacgctctctagtcatcaacgaattccatttatttctttcctcaataaactttctccacgtgcatcgaactttacagtggactcgaccagattagcgtttaccgtttgggccagccagctcgttggcgcgggccgtggccctggccccgggcgccctcacgcccgctggccgctataaatagcgttcggcgttcctgtctccacccatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgtgagttttccttcctctcgtccttccttgcgctcggtttactcatcctgctgccgtgccctgcgttgtgtgcgccaggactctgttgggtcctgagaggagtggccggcggtttcgtctgtggtagatcgtagtacgttggcttagatcttggttaggttcttgagggcgcttttgattttcgtcgggagagtttgagatcgccttcctgcccccgtttgtcggaggtgtcaggaaaacttacattttgtctgtgctaccttagaatttggatcctgataactgctaatcgtttgtgctgttctgctgcccaagaaggagaacttactctctttcgatcgacaggttcaaggagattgcatttgtggatgctctaatggagtcgaaaggtggcaagaagtctagtagtagtagtagtaatttcatgtacgaagctccccttggctacaagatcgaggacgttcgcccagccggaggaatcaagaagttccagactgctgcttattccaacgtaagaaccaaaaaacctgcggtacaagcaatgccgttctaaatctacttctcattgatacgttccacgctttggttactgacgctcgttatttgtttgatcttttgttttgcagtgcgtccgccagccatcctgatatcgcctcacatgcaattcgcggtagagtaggattttaattcagttttcctcttgtgtcggtagttttccgttggctctggctgccttcctctgcttctgagattccaacttgtcttgcccatctctccttttcctctctcatcctctctttcttgcaacgtcatccagtggcg

SEQ ID NO: 13655 - DNA, 126 bp, Zea mays
aatggatgttcacaaagggtcagggaaagacaatgggaagctattacaccctgttgaatgctttgatcgagttatttggaatggtactctcacgacatatggagggttttgcctcgtacttttttc

SEQ ID NO: 13656 - DNA, 460 bp, Zea mays
taaagattaaaatagagagttaaaaataaagagtcgtttggagatgctcttataatgcatctttagattagttataaaatatatttcaaaatagatgtatttgaagttattatattttgacgatttggctgtggttttagtttagcttatttgcaccgttattatgtcagagatcctcaagacctcaaccgccgccgcccggagccagccacgcgccagtcaagttttcagtgtccggctgccggcagtcaccgcaaaacgaaatctctctcctccacctcgtagtcgtagccgtttcatccactttctagtttcctttctcctcctccagccctccttaaaaaatcggccacggttatttatttctctcgccccgctccgctttcctaatctgcgagctggggggagatcgagaccctagaacggagggcgggtgtgcggcgctgagggccttagacga

SEQ ID NO: 13657 - DNA, 1500 bp, Zea mays
ggtacgcggtgtcccagcgtagcttggcccccgtcatggtgcgcaaggtggccggcgcgggcccgtctagcgcactgggtcttggcgcgggtcggcgtgcccccggcgtgacgcgtagcacttcggcacgcatgggacgaggccggctacttcctaaaataacttggttaacccccgaactaattcgtttttcccttcccccggggtttttatggcccgtgaaccgggtggttaatttaaggaagtggacctcaattaaaaatggaccacgtggttaatctaacgtagttaaaggacgactaaagtatggtcagccatttggaatgattgtaactctgttagtgtatgtgattaatacatgttagtatggctaggtagagttagacgatgtaataattaattgcacacctacacgtaatacgtctgtaacaccccagagtccacaaacaccccggaatgctactgaactacacatctgacatccatatataaaatttcggcagcatctcctttgaaagattgcataaacgaggggcaacagtgtataaacatatatcatttcaaaaaacatactaagcattattaatatgctagcaaaggaaagttaaacataacaacatgaactgaattaaccagtgcacacgactagaaaaaaacaaacatcatttgacatcgagtttctaattaaatcatggctgcaactgggcagcgttattataatagtgaaggtggacgtgctgctacttccctcattcccaacatgaatcaaatacctgcattgagtaatgcaagagtgagatgaaacatctcagcaagtaaattattttgacgagatatttaaaccaaaagaattgaattaatcaacattttaaaagagatcacaattgagatcaaaaatacttgtagatatagaactcaatagtcccaaaataaccaatgtcatctcatttcctcgaacgaccacaataggttgtataacacttccctcttagagtataaaaccacaccatctgcaaatatctctttaatgaatgcatatgaatgcaatgcatatgtcctctgccttcattcctctaagggtatgaagccgcatcgtacccctcctcgggcaacttacgatgctaagttgtaccggtacggtcggaccataggtcacgacaaaacttcaaatgcaagtgaatcatgcaatgtatatggcatgctgcatttatcaatatacttcacttccttcaaatacaatacaaacctcaaacaatacttcgtttaccttcagatacaatacaaacctcaaataatacttcgtttaccttcagatacaatacaaacctcaaataatacttcattcaccttcaggagtgtgaattaatctcgtgggtcttactcgaatcatcatcatcatcaatatatgattaagcatcaatataatacaatcaagtaaagcatcaccatagagttcaattacgaaagaattcgatgattctgaatattagagtgtaggcg

SEQ ID NO: 13658 - DNA, 255 bp, Zea mays
ctgtactcaattgtcactcatagacgacgacacccttccattcctcctcctaggctcctaccaatcaatccagcagcacagcaccctataaaatccagccatcacctctgcccacttccagctccaacaagtcacctgctggtctctgagctccctacctatcactcccattgccatctccatcctcctgctgtgagcgtgttgtgtgagcccggccgtccggactctgttgacgagtgagaagcaaggatcgcc

SEQ ID NO: 13659 - DNA, 61 bp, Zea mays
ggtcctcgtcgctgatttctgatttctggcgatctatcgagctaaagctagcgcactgata

SEQ ID NO: 13660 - DNA, 1027 bp, Zea mays
gtagactttcactttcaacgacgaggagggaccaggcaacgcaatttcggtccgagtttactgaaatctggtattttttttcgttctcggtgattaccgaaacacagatttcggtccgggaagttatgtttttcgttttaaaatctaaaagtcaaattttggtcaaataaacgaaatccagaacggtgaaaacgaaattgtaatccctgggaggaactcgtgtccctatgaactattttgtttacacaaattacaccatacaaatatactagagcattaaggttgtgcatgcatgtatgtggagtgaaaataattaatggatctaagctcctttagaacatagaattttcaggtttattttcaccagaaaagaaagaaaaaaaacaaatctcacattccaaagggaaccctaactgtccttagtaaaacgatacacagttcaatcaagttcataacaaacagtgatattcaagacaccaaacagatctagtataatataaaaatatattccacaaaaaaactaacatatctgttctcgaatatttagacacccgttaattttattttgaattaaaacgcgacaaataaaaaaagatcagagtgagtataatatttaattgtatataacataggtcaaattcaagatatttttattctttaatttcgctaagtagagtaattttttatgtcaggttcttgatcatggacatgaagttgattagcctcacaagcttgcgagaacaaaaaactaaatcaaccaataaacatgacacccacaactagaattgggtgttatggtgtatcggtgacccctagcaataccaatactcaacccttccgaatatttcgtcgcaagatttttcgctagtgctcaaagctccaaaggccccaagactccttcctgctcaaacctttttttatccatccttttgcgcggaggctgttggagcgttggatagtgcgcggtgccggcgcactcgctcgcagtccaagaacgaaggcagcctctgtttccttccgaccggcg

SEQ ID NO: 13661 - DNA, 1500 bp, Zea mays
agcccaagacttatgtgctacattaaactatgtgtgctccagatttacatggcttttatctatgtttaattaagacttgtgtttacaattttttatttgttgttaagttttgaatatatggtttcatggtgtaattttaccgaacaaaaatactggttcccgttttcatccctaatgataatctattatcgatccgaacaagcagtaacagatcactctcaacaatttatataatgtcgcaatgtacatgtacaaacagctacctagttctatatgaaaagaacaacaaaagactggccgtctatactacgaagaagaagaagaacaaaagactggccggagccggctcgcatcgttccatcgctgtcgtgtcgttgcgttcgaggtaaacacagacccgacaaaaagttgtcgagcagcagtagcttcttttttagagcgacgcagtagcttgtttgtattcagcgacttggggagatttgagttgaatctcgacgccgggtgctactactggaagtctggaacgtgcaactagctcgtaaccactaaccaacagcgctgtgccacgtccaatgcctttttttttttgtacaaaggtaaaataacgccacgaactcacaccattacacgcctcaccacaggcacgttttccgctagcgtggacaaaaaaaggtcacagccgaatgtcccgcgatcaacatgcatgcggcatgcatcccacgcccgacgcccgttgttcaatcatgggcatgggcggtggtccgccacctgaccgcgtaatttaacgaccagtagtttattgaaaaagaagatcgtcgttctaaacacaaggagaaactggaatccatgtccatacggtggcaacttcccaatctccgacggatgccgaaacctttccgcgtccaaattccaggcctttactttggctattactccctgacaaccgctacggtacgcaaccggccgttgctgcttgtctgctactgacgctgcggcacacagggtggaatgcgccgtgcagtaccgcgccgaggaggatgaggattccacgtccacggcacacgtactacgtttggcagtagtaggctgtaggccgcccgggcaccgcatactacggaattgagtcgttacgctcccttgcacggcacagggagcacggcgtccgcacctgcgacctcgagcagtcgagcgcgagcgcgagcgcgcaccgggcacgccctttcttatgtatgcgtttctttccaacctgggctctgactcccaccgcggaccgaccgaaccgattgcccctccacgcgctccgcttcgcacccaagtcctctagccgtttgatcccagacggcgcgacgagagcgggaggttctagccgtttcctcctcctacagtcccactccgcagtggcacggcggcgccgccgggttctcgatcgggctgctcccttcacttcacttcccttcccttcccttccttacccgccgccgcggcacacggtgcacgtgg

SEQ ID NO: 13662 - DNA, 417 bp, Zea mays
tgtgggaggcaaccgccggaggaggaggagacggcggtgacggccatggggacgccaccattcaaacggttgcagccttgcgctatgctatatgagtcctcccagaagaagcaaaatcgcaatggtccaattcggcccattgaatgaaatcttgttgcggccttgcgggttggcgggttgccaggttgtgaagtcttggagaaacacaagcaatagcactagcggcctaacgcaaaagaaaatacgccatctcaaaatgaaagcgtaaagttgacgttgacgtgtcgtactgtcttcctcgtctctcgttactcgcgccgtcgcgcgtggtctccggacgtctcattcggcagcgaggagaccaaggcgggggggacttccgatctggtgtagggtacactggtttggcgcgagacc

SEQ ID NO: 13663 - DNA, 1500 bp, Zea mays
gcctagaaaattcctgcgcatgggcttatcttccaatttcctaaattactctttgcagcccattctgcgtttcggcccatttctgacccatttaaattctggtgataacacatgcccctggttttggtaatggtaatttcaaaaccaccgttttattttccattgccccatttttttcgtcttcgggggcgcatcgtgcctctttaatgggatatgacatctctgttcataccctcgggaaccagcgtagcgtcgttgaaagggaaatgggcttaatcatttcttataatcgattttggtgtttgacgtccatcacaaaccacgtggactaactagtttacctagttgctattttctcaggtgcataaagttcaacataaacatacaaagaaacagacttgagagaattctacaaagtttggagcatacgagaattagtgcaaccagtggccaggctgcatcccttcgcatactggccgctctcaggttttctcaaagtcattccattaaaatttaccggactgtccgatgagccaccgaactgttcggtgcgacaacgaagcaacagtcaacttcgcccaacggtcgactgcgctgactgcagcacctgtgccaccggactgtccggtgccgcaataagacagaagacttcaacggtcaacagctccaaacctcaacggtcggctgacgtggcacacaccggaaaatgaacagtgcagtatccggtgcaccaccagactgtccgatatgcccatcaacagcaaagtcagccaacaactaggaagtaattggaggctataaatacccgccaaccaccaccattcaagccatccaagctttccaaccttctcattcaatactagagcaaaagcatacactccaagacataatcaaagcatcaaattctgtccaagctccaaaatcaaatcaagtgcttagtgacttgaaagaggatgatttgtgtttcttttgttgctcttgttgctttattactttcttcttctcactccaatcatgcttcccgcagcttctggccaccaaaagctcctgtggactgtcaaacgcttagcttttcagccagcttctataaaattcgttggggcaaaaaccatccaaaatcaacataaacacataatcggttgagtcgttgtaatactagtaatccgtcactttctagatcctacgccttataaacaactttatctttcttcacacgtaatcataatgatactcagattttccccaaagtcagattctccccacagccagattttcaaaaaagctggtcagaaaaaactgaaccaaacatgcccccaagaggcgtgtatataagcatgttggtacggggcgcgtcacattactcgaccggcagcccacgcattcactttgccttcgctttagcctttgtgctgctactactaacttgcaagggacgtcggcgacggccaggccggcgcaccgctcggcggcccggccagcccacccagagaccacctagcc

SEQ ID NO: 13664 - DNA, 519 bp, Zea mays
ctggtgtgtgcgagctcacagtcacaaaagaaacgatgtccactggcgaactgacggctccgtcatgcggcgatcgataaaaatgccgcgaggccaccacgcgagacgaacgcaaacgaagtgcggaaaataggcctattttttcttcttcctcgtagagatatttcggaagagggagtgcgtgccttcctctcagctgattcgccgaggtacaagcccctgctaattcacaagcttgcatcataactcaaccttgcgttttgtggaatttatccagacgagggcttcgattcgatccaggagtcgcccaaatcgtcttgtcttcgacttcggttcaacccccgaaacgaaatttctagggttttagtgtcaattttgtcccccttcattacatttgattggcggtggattggttcccgttttgatgattccctgggttcgttggacggcaggacacgagatcctctagagggttgtgctgtttggcgtgaggctttgggggcgatttgctttgctcgc

SEQ ID NO: 13665 - DNA, 398 bp, Zea mays
ggtaaatttctcctcgggatccaacaatccacccccatttttccctgtcttttgttcttctgcaccccctggttcttatctgcattcgtggaaaacgccaatcaaaactacatcgctttaatttctccacaacgatctacaggctaagaccttatttatataacataatatccacctcaatctgtaccaatccatcccaacgtatatggattgaagcggatgattacagatgcatcaaagcggccctgactcgttttcggattagatatacggaggtagtctcactgcgttcgatcagcagttgcagttcttgttggagatatcatgatgcaatgcaactgcatacacccgcatcttgttcttgatccatcgcctcacatgaactcgccgtacgcaga

SEQ ID NO: 13666 - DNA, 190 bp, Zea mays
cgtctcgcaaaaaaaacgacattgtgtaaaataaaggaatatctgttgagtaatggttgtttttcgttggtgcggtgcggttgtcagccagaatcctgaagcgactattgtccctttcaattcccctcccctacctgaggccctgaagcctgggtagccgatccatccgaaattccgaaacccctgcggc

SEQ ID NO: 13667 - DNA, 658 bp, Zea mays
ctgtgtaatctataaacttgggcaaacttagttagtccaattgtttgtgttgggcaattcaaccaccaaaattaattagggactaggtgtaagcctaattccctttcacaatgcacgaacatcgtactagttcaactgttcaagtataagatagagtgagtgagtatttgtttttttagcactaaaaataagcaacattgataatgcaattctcccttttggtcccagtctcgtcctggtcctattttgggccaggatgctcatggccacccgaacctcacacacgtcgcttctctccctgaatccatgcatggatcttttatttagcgacgactttcccctcatttccgccctttccgcgcgcgctctgtccaaatccgcgggcggaatccccctcgtgcaaattcgcagtcgtcttgtgcgccggccggccatgatccaccgtccacgccgccaacctcgtcggccgcggcattgttagttctagttgttgttgttgtttagatagcattattccgtcgtcggacagatctgccgccattgccgcgcgcgcgttacgttacgttgttcttgagctgatcgatcagatcggagtcggaggagaggagggagctagctgtgctagcatggggccaggagcgcgcgacggcggagccca

SEQ ID NO: 13668 - DNA, 785 bp, Zea mays
cgaacaaaccctaaggggatgtttgtttataattataatccgtctagattaatcctatatattttgaactaacacttagttcaaaatatgttggattatataatctgtacatattataatctcaaacaaaatatacttagaccatgtttatttacactctagattatctaatgtagcttaaaaaagttaaagcgataaacaaaaatcaccgattattaggtggattatataatttaaatacctagtttatgataatctatatgtaggttattagatgctcatataatctataatctagactatataaatcctagaagtaaaaaatagagtcttagcttaaaatttgttggattatataatatgagcaggttagaatcctatgagcagattagaatcctaaacaaacatctcctaagtgtcccaaggcctccgagcaacattacaccacaggtccatccagcccatttgtctgctcaaactttagttgaaccagcccaagatgtgtccagcccacgtattaggcccgaaacaagccagccgaccccgtgggcgggcgatcacatggtcctatgtccgtgtgatgactacggggacccaccccagcctcccacgccccttcgttcccagatccccaacgcactccactctctttcagaacccaacacgccactgtcgcggtaacagagcagctagccaagagtagtagccgcgtgcccgcgtgcgcttcccgaaccccgagtcccgaccagagagagatacggagaggagcagacctgcccgtcgca

SEQ ID NO: 13669 - DNA, 156 bp, Zea mays
tgtgcattggaatggaataccttatgccggaggtagtctgagtttttcatcgtgacttgggagatatcctatccgccctgattatcccaggacccaggttctccgcggtgtgttcctgacgctgttgaggcccggcgtgtgcgttgcatgcagggg

SEQ ID NO: 13670 - DNA, 1082 bp, Zea mays
gtccctggaactgatattcagctaccatataaacccgctaacttgctactacacaaacctgctaacttgctactgtagaaaactgaaatattcagctgccatataaacctgctaacttgctactacacaaacctgctaacttgccgtttccagtgtcgggcttccaagggcgcaagttctggcccggtcactagatgggcctgcatgtctgattcagttggaatgggaaacgcacgccgagtcgccgacggcccgagggtgcagttccgcgcagccgtcggccgtcgcttctggcagcgcgctcaccctccttcccaattcgcaacctcccgcctctttttctccccgccccgcgcggccgaacaaaaccctagtccccctccccactccctcagtccccattcccacaccgttggtggctcggaaccgccactgaccacttccctgaccccgcgctctctccctctcactacagtcggagggcggcggcggtggcgaaccgacggcgtatgtaaggtacgctctgttgccatctccccgcccctaccacttcagcaagtgcactccctcaccccctcctccctcctccagttggtggatagagaggtgttgcggaagccgggaaggtattgcgcaggaaaacgcagcctcccctattcgctggttttgcactgttcacctgtcgtcctatgtttctcttttctattaaaaaagcttccgtttccttcagttcaccacctgttcggtgctaatcgcagttactatcttgccgttactccgaacatggtggccgcatcttttgatctgtgtgcttataactgcagaattgaaagccacagcccattgcggtagttgtttgttgtatgtgatacgatgagcaggaacattaggcgtatccgaatatccctgtcaactgccgttagagttgggtcagtgacgaatttcttaatctccgagaaatggaatttcactcattcaatttatctccaggaatccaactgaacatttgacttgcttgttccgggagatctcttgcctaactgtgagcgagcgagttgtcacagaacagttggctgctcaca

SEQ ID NO: 13671 - DNA, 1500 bp, Zea mays
aactctacatgtaggcttgaatccttgtatagtatttgtctaggttccagttggttggagccattggattatagctcgaggagaacatgcttgcaattgatgtctactggtggtttaaaaaatcaactgcctacgttctttctccatcggcctagcaatgacagagctacaaggcggttctttatgaggtgaggaggcatggctcggtcaaggatccatgggagaattctaatcaatctaagggttagtttagaaaccatatttttaagagatttttatttttccaagagaaattattttattttttatttgaaaattatgaatccattgaaaaaaaaataatattcatgttatttagcacatgttatgacctattttaggagtaaattggatttttcgagcaccatgctcacgaaacattaacgtgaacttgcgatctagttatttaaaattgtataaaacacaaacgaaaacaaaaaatcatgaaactcgttgacatgttatgatatcatgtttgagtgtttcaaaatcataataaaatgatagtaaaaaagttacaaataacaaattgaccatattggggtgccttaaaatcaatggtatcatattcatctagtgtggtaagttcaaatcgatgaaaccatcattttgtgcctccatgtttaaatcaaatcttattaaaaaaaagctaagaaccgatgacatactaaacagataactgcatgcacaggaactgaagaaagaagccctgctggaaggctagaaaaagctcacgctcgagaccttgatgccggcttgccgtgcgtttaaataggctaagataaaaacaacctgtgtttaaaaaataggctaagacgaagacagacacgacgggaaccgaaaaaagagcaacataggcacgaatgaaaaaaattaaaggctactttaaacgcctcattttccaaaggatttctatttttaagaaaaaataatttaattttacttaaaaaagagaaatcatttgaaaaaaataaagtttctaaactagtcctaaaataaaaaaaagcgccgcacaaatggccagcgcccatccacaatcgctagaacgcgcgcaatggaaaaaaagcttgaaaaaacgctgaacccgggaatagaaaacattgaagccttgaagggcaaacatagaagaatagatagattcaaaataatcatacctggtatgctaaatcgaaacaggagggagtctgtagtagtccagttcacaagtagcggcagctagctgctgttggctgttgcccttctccgaaagaaaactactcgagctgaggcggagtagccaaggagaagtcaatgccgttctagcagtccagctttcacatggagcaggtcaaacaccttattacgcttgacgctttgcagcagcgatctcgatctgtggaggattgcatcaacctgacaatctctcgagttcttcacctcctctctcccaacggcatccattcagcccttggatgaccaggc

SEQ ID NO: 13672 - DNA, 1500 bp, Zea mays
ttccaacttaactgtgaattaaactcatattagctgtgtaattttgatcataccctcaaagcaagattttatttatcctatattttgttttattttggatagtagatctccttcccttctccaactcttatagtagtaaattaggtctcaaatcacagtattatcattgttcgtaaatgcacaatcacataaactctagcatgatgcatggtgtattttagatgcccttgtttttattactcactcttgcttataattattcttttgttgtaatgaatagatgacacacaagtaaagaggtcaataatattcttattgtatacatttttgggtattacaaacccttaatgaatcgtacgactctgataccaattgagagcacctagagtggggggtgaataggtgatcctgtaaaaatcaacactaaatggcacaaacttggtttatgaaatgttattggaatcaaaaccaaggtgctatatctatagagaaagagatgacttcttcacttaattgctcttcacaaagtgagtatttaaacttagagcaattatcaagtgagtagaagcagagagaatcgcacacgaataacaacatgtgacacaacgatttttatcccgtggttcggccaagtagaacacttgcctacttccacgttgtggcgtcccaatggacaagggttgcactcaatccctttcaagcgatccaatgatccacttgaataccacgattttcttccttatagcagatgttccctttgtgaagaatcttcacaagttggagtctctcacccttacaatattgatcacaatgaaaaccacaagagtaagtgaaagggaaatgtgcccttgggccatttctataatgttttggtgattaaagtgtccaacacatattaagtgagttgattatgtgccaaacaagcaagaagtgtaaatcatgtaacaaggtatgtttctagacttagtacattgttttgagtactaacatatattgtctaagtgctagaaacagagaaaataagagaagaaaataaaagcaaaagacttggcttggtacagccaaattccagctcggcttggcacatcggactgtccggtggtgcaccggacagtgtccggtgcgccaggtcaacctccggtgaacaggccactctcgggaaaaatcagcggcgtacggctataattcaccggactatccggtggtgcaccggactgtccggtgagccaacggccgccagcgcaacgatcggccgcgcaatccgcgggcgacgcatggcccgcgccaacgatcggcagggggcaccggaatgtgtttggtgcaccaaacacattagtgttcaagaactcgcttcaagcacttagccgttctaactttaataatcaagttttatggctattagtgttgaattttacaggatcacctattcacccccctctaggtgctctcaattggtatcaaagcaattctcttcatctaagggactaatcgcccgaagag

SEQ ID NO: 13673 - DNA, 653 bp, Zea mays
agtgagatccgagcacgattttgagatgtcctaagtattctgttagaatgtgttcttgtgatcttctttcttgtgttgtgtggatgcattttcctcttgtgtgtgtactctcctctttgttttgctgtactttggtgttgtaacttattcgttttgtgtacggctggaagagactccaacgtgtggagatttcttgcgaggggattgatattgatataagaaagaccgtgcactcaagttaatcattagatcacttgagaggggttaaatgcaacccttatccattgggacaccacaacgtggagtaggcaagcatttgaggcttgaccgaaccacgggaaaaatcgtgtgtctatcttgtgcactttactttcttgcgatttattgttcctctaagttttttaatcacacttgtaatgttgttctaagtccaattccacatcaagagaaatcaagtgcatgaactcatctccatatttcactttcttggatctttgtttatactaacttttaatttgtgatccaagtttctgttttagttgtgttttacagacatcacctattcatccccttataggtgactcttaaatggtacatgtggaattgataacgatgtaaaagtttggactccctctgtgattgagcgggcacct

SEQ ID NO: 13674 - DNA, 259 bp, Zea mays
aattatttattatttatcaccatatgtaattaaaaagagatgaactctagaaattctgacagaaattagaaacatagcaattttctaattttagtttcatagacattaatgatcaacgccaataatatccaatgggtggagtcttttgggtgctatggattttgagtttgttcttgtcttgttgaggtatgttgtcagttttgctgttttgcagcacgaccaacattccttgcgtttagaagtttagtaggaaaagcac

SEQ ID NO: 13675 - DNA, 536 bp, Zea mays
ctcattttaatctaacgtctgtagttatttgatatatttgctaaggcaccctccgacgtggtgggctgtagtggtggaagatgttatttgtaaattataatgatcaaccagatacgttagatctgagatagatagtgatgatttaatatgtgcaccatgtacattggatatgtcctctaatattgaagaaaggactaaaatctactcataatatttttttgggattctcttaaaaacagatttttatgagttattttcttttcgaacgcgattacacatacgaattgtgagttccggtacgaataggattatttaatgatccatgatttattaattcagaacaaaagacaagaacaagtataatgttggtgtgttttccttgctcacaggagcaatcacggcggtcatctcgctaacgctttcctcttggacagttccacttctctgctggcctgccacaaggctacagcggcggcggctgcttcgccggccggccggccgccccctcctgtagcgcgctgagcaagtcaagtaag

SEQ ID NO: 13676 - DNA, 1500 bp, Zea mays
cacaccgctttgtggcccgttacgtggttcactcttgtgaagaaaccgagagcagagaggaagaaaaaacttatgataataaagtactcgaaatgattcaagcgaatacggcgcgtctcatctcttatctcaccttttattttaaatttcactctgtaaacagtgtcatatacagttctacgttcactattttacgctatgcaccggagagtcttgcgtcccctttatattaagtagcacaacggccatgcattgccaaggtgaatacagattttattactatttgtttttataagagttgaaggggaaaaaggaaatgatgaactaagtgcaatgaaaagaaaaagaactaccatctcgccaccaattgacatgaccagaagtataataacgctataaaaaaaagaaccggaccaggaatgaacgagatgtcatattgaccatccatctcatagtgcacgccatcctgaatctgaatggcacacagccacgacgcacaatctggatggccggtgacacagcagagtgaagagactgttccgacttgcaaaagctagcggccgagccaccggccggccgaggccgaccgacgcgaggggccagcgagaggaacgttcagatcggagcagggcgaaggccgcacatgccgcggatgaatccaacatcatgcatggtgtttcaaagcccctgccgtccagctaggacgccggtacgagacagtacgtccacgtcatgctcacacagcacagctgggcggggcggggcagggacttgaattgaacagggaggaccggggcccagccgtaccgcgcacaggtgcccagtccccgtcgcatagcagtagcaggtgacaaccaaaccagcacaggggtcgcaaatggaaacgagaacaagcgaaagcgtatcagtaacacagctgatagtaaattccaaggactcgagaagaagagagatgctccaggtcgtgttcagaggcgggcctggttgcctctgaagagagattagaaggctgaatcatgcgtccgtccggggacgacgatgcgtgcgtgaatgattgacacggactacgcgtacacttgcaataatgctgccgcatgcccccagcagcaccccgtcccctccccctattaataaaaaaaaagattctgacagccgaaagcgcgcacggtgcttgctgctgacctgccctgcccacgccatgttcgcgcccacccgcttcacgtggccggctccccgcggctgaccggatcgttgagcccggtcgtacgtacgtcgcccgctgccccctcgtcgtcgcaccccggcattccccattcccgttcccgttcccaggcaggtacgtgctcggtgctcgccgcggatcggtcacgattcacgcgctacgacgacgatgtcatgtgatatgatgtatgtacacggccggcgccgccatcgtacacgtactccgtgtagtgcgttgcttgcagttgcggtgggcggcggcggaggcgtcgacgaagc

SEQ ID NO: 13677 - DNA, 419 bp, Zea mays
tgctttgattttgtctagctctttatctttctcgttctcatagacaggtacacatatcttaattgtttaaaaaatgattttatcaagctaaaaagtatttgctttgttgaatactagtttctatagagtttttgaacatggtgtttgttttcgaattttggtctagattttcacgagaggagcagcacattctaggtgggtgcgcaggcaggcaggcagacaggcaggcaggaggctatatgagaggaagtttcgtgacttgaggaagaatagtctactgcttgggaagggaaaacgggggtgcatttgttgggatttttccaactcaattccatccaatccaagagcaagtttcaccggattgattccccaccgcacccgaccacaaatcccaccaagcaaaccctaatccgtcggcc

SEQ ID NO: 13678 - DNA, 158 bp, Zea mays
ggtagctaactgaccgatccgtgcccctcttgtcgctgcagacgcaaatgatctgttgcgttggcttctttttccttcttcgtttgattgcacgctctggctaatccagacgcttatttgtctggcatgcaggcactgttgctggagtttatgtgggc

SEQ ID NO: 13679 - DNA, 705 bp, Zea mays
ggtacccttgagcattatcactctgcagtgctgtgacccttttagtttctgaattggtagagattagattcgaataacttagattgctagcgtcagcttgattatagaattgtattttagtacacctccgcctattcaggaacttagactgtaacagtttctgaatttagggagatttgattcccagaaacttagattgtaatggtatttacatcgtgagcatctcccccacatttcattttgcaagcacttgaattattgtatcatcgtctagggagatatagtcatgtagcgataagtttccaaattccattaaacctgcaggtgttaaatagtattgctgtagtcgtgtaacttgcgcatactaattccctgttgtccatgcacagtatctaccagaatcctgcgattgtgcaagcagcaactgcagccttctggacatcctgtcgtgtaatatccaagtttctgtgactagtcatggctggacctggacggtgcaaatatgcaaacattgtgtggctgtggcctctccgtttctaaagatcaaccgaagatgaaaaaagttgccaaactccgtggcgtgcttagattatgatgtaaataggctgcaagttcgttgattgatttaacagcgacatcagttactggtgatgagcaatatggggctgttcgacagtatctcacccatataatctaaaggtatga

SEQ ID NO: 13680 - DNA, 79 bp, Zea mays
cctagcctcacttttgcctccgagtttcctctgtttccttttgatttcgcttccgctcagcccaccaatcgagattgcg

SEQ ID NO: 13681 - DNA, 1500 bp, Zea mays
gtatgtcacaactcacaagaaaaaaaatgtgtgaggtttactcgacgctctaggattattggttcttgtttgcaacaactatttctaaatgttatgtataagcataaccaagagtgaaggaagcttaaccattttagcatgaagattcttccccattctaacatagacatgtgtacaaagtttgttgattttgatttgcacaagagctacagtccataccgtcttgcagaagtacatgtagatcaacctttagtttttggatactgatttttgcatccatagatctggtgtggttgcaaacgttgagttaatcattgttggcaactacaggagcaatgcctaccgcaattttatagcattagcgtgagtttttgatgtttttaaatttaatggacaaaccatttagtaggatgatggagatctatgcattctcagattccgatgactatggagatcaataattagagtattttgtagtgcacatggatttaggagctaatatgctttcaactcatctccatttcaaattataagactttttagattttctaaatgtgtagttttatgtacttaggcactttatctagatatcataaaaatgtatctaggaaaaataaaacatattataatttagaaatgagtatataaattgcattacgaacatcattgatgcatgagtatggtcgtcatttaaagtcctatgaaattatgtaacactcctaacaaataatgacatttaggatattagtaaactttctcactaagctctaccactagaattatatactagttattatcgtgtggcctttctatgttagacatatcttggatccatagtccttccatgtcttgtgcctaaatgacaaatgttgacaaccaaacatgttcaatttcagaattactatgtacctcatattttttagaaaaaatgtcatctgtacacaaaattactatcatactcgaacataatctatagttgattgctggtttaagtaaatatgttttagcttttacacaaaaatatcagcttgcaactattttctcgtagctagaattatatttttcaaaatttagctgaaccaaacagatcatcaggtagattaaagttttaaaaaatacgtaagataattttaaaaattatttatttagaaacccttagaagccacgcgtcacgctctcagtggctggcgtctgcgcaccagaggatccatagcaggcaggcggtgtagggtactagcagcaggccagcagcacagtaaacacgaaaagcaagaaagtcacgcagtcacacgcatccgcagcactccgccactccctctgcttcagacagaccagtgcgcgctcaattaccccccgacccctaccgcgtccaccacaccaaaccgtttcacccggacctgcccccaacaccctgctctatcctcatagcaaaccaccgcctgaattgggcggcaattgggagaggattcgcggcaggtagggcgctgatccgttggcgag

SEQ ID NO: 13682 - DNA, 996 bp, Zea mays
tggtcgatgtgcaccagactgtcgggtgagccaggcggcgaatggctctcgccagcgccaacagtcggcgcataatcaacggtggacacgtggcagcaccagactgtttgatgggtcgggcatctgaaggatgcaacgactaactcaacggtcaacgtggctgataaggaagggaatcacgtactgttcattgtccggtgcacccgcagacagaaggcaaccagagccttccaaatgaagatcaaacggctcatttggcccttggggctataaaaggacctccctaggcgcatggagctgttacccaagcatacaaagagcacaccgaaattccgattcaacgcaaccacactttcgactcattctagagagaattgagtgttttcttgagagaaactctgtcgtttttattcatgtgttctctcctttgcttatgtgtgtggtgttgctgctcttgtactcttgtgtgtgtttctactccctccttactcttgtgctttgattgagatcattcgtgtaaggcatgagagactacaacttgtggagattcctcaaaagggatttgatatatggaagaacaacgtggtactcaagtgtgatctttggatcacttgagaggggttgagtgcaacccttaaccaaaggaggtcaccacaacgtggagtaggcattggctgaaccacgggataaaatcatcgtgtcttttgtgtattttatttattacgattgttgtcttccaagagttctcatatttcacttgcattattgttcctaagtttaatgcacatatccaaggaacaatcaagtgaagagttctcttctcctctccacctctactcataataacttggttttagttttcactaacactcatcataaaccaagtttgttttgtttagagttgatttttgcaggatcacatattcacccccgtctagatgctctcaattggtatcggagccgttctcttcatcaagggattaatcccccgaagag

SEQ ID NO: 13683 - DNA, 1500 bp, Zea mays
catttgcgatacgtgcagagggcttcgtgtagaacctatatctcgcctctcaagagggaccctatcgggaaggagatcgtagggttgctttggaatcggcaggtcacccaaagtacctctagacgacgtagagctaaagagaggcgaagattgagattggggactgaattaaagttacgctacatcttaacataagacatgaaaataaataatttagatagatcatttcgattggatcatgtgtgttatcaatcgaccataccactttatatttataacactttatatttataggatatgaggtatgtaccttattctaagcgaagtctaacaagataacacaaaacacggagaatctctcgtaacaaattcgaacgatcgttcgaactaatctaatatcaaacggttagagctaaaatttggactgtttatggatgggaccgtccgagcttacctatggactgtccgacaatacgacaatacaagtgctgctaattttgatgcaacgctaataactaccctatgcttctcaattggtgcccgttcgccgttcggcaccctacagtccggaccagctgcgctgcaatttgcaaccagacaaccaaccaacaaccacggctagactgaagtactgaacgatgagcgaatgctcagttacccacgcgcggattatgttagggctgtacagtgaagagatattaaaatgattttgcacataaaagagttaacttaggcagtgtttggttgaagagccaagtagaacgcaatcgttctgttccagttttgttattgtttggttacaaagtaactagaacggaatggctccaattagggaatatactccttagatccggaaccattccgctccaaaaaatcaatgggacggagccgctctgttccaattccgctctcacagtcacgctctgttccgttcactctacaaccaaacaaaaaacagaaccgctccgttccagattaccaaacacagaacagaacggctccgttcctagaaccagggatggaacggcttcattctatttggctcctcaaccaagcactaccttagagactatgttatataatgagtgtctataaatatagtttattggtaaatatagaggtaaatgtgtttgtccagtattgtatcgatagaacaaacgacgaattcgtccttggattactaggcagatgggttatccaccgataacggatagacgacttcaccaattttttttataaacacacccttaaacatcccaagacatcactgtacatgccgtgaggtggtacaatcctgagtcctaggtcaattggtcaaatccccgctcgagcttgataaaacacgcaaggctgtctgcctgtctctgctcccatctagaaatccacttcgattcgccctggacgctcctgcctcctgctagtcgacgcgcaatccttggcaatctggcagacaggtgaggcgctgagcctgctactactaactaggagccgcggcgggaa

SEQ ID NO: 13684 - DNA, 526 bp, Zea mays
gttttacatttttagttattcatacaataactaatgtatttattttatatatgtctctatattcatcatcatctatttgaacatagacataaaagttaaaaagttaaaacaactaatattttaggacggatagagtacttcttttcacaaatccattgcacaagagcaagctggaagtagtgaacacgacacatttcacataataaagtcagttcatccgaatgttaggatggatatgttgtgcgtgtcttctgtgtcaccagtttatgattttcattcccctacatttctccaactagtttaatagaagctgcaccgatgctgaaatgatccaccatagccccctcatctcaagtgcttgtcaacccaatcaaacatctcatcagcgtgtaagctcgtcatctcgtggtatccataagcaagatttagctcttcctggatgtgatcagccaacgcagacacctcttcccagaggcccctcttgaccaatgcatccttccatggcgtttcccggccatcctctttc

SEQ ID NO: 13685 - DNA, 1101 bp, Zea mays
agaggtaaatacttgactttgtttaaataatgttattttgacttaatgttacattatatggtagtacatattgaattgaaattggaacattttttacacatcaattgcactgtgacatcattagtaaaaaattctacatccgcccctggtgaaggactattctagttgcgtgacagcatctcaaaacagttaaaatatcgctgccattaatgtgtgtcagcatctgaaagttgtgatttgtctttttacagtccaacttgttccacttgttgtgatgattgaacatcggcctcaagcaaytggatattttgtatgcgcaatgaggtggtctccaaagcataaacgttcagaatggcagcaccgataaaactaaggtctcatgaaggatcaatatattatgatatttagggtgtatttatttctcgcttaaattatataagctagattatgatggaagagtataaagataaaatatcattttataatcacaaataagctgaaataagctatccaacgttagcttattcaggttatttaaagtctcaaagtgatattttatctttatatctttacgctataattcagcttatataatctagaagaaaaataaataagaccttagtatgacctattttttttcctagccttgtgcaaaaacaatgtagagccttgtgcaagaacaatgtagctcatagcacggctgcgtctgtacatagcacaagttttttttaaaaaaaagaagataatgaatcgttatagaatgaacgaaaccatttgctaaactatgaacgagactgtgtatatacatagcacgactgcgtatgtacgtagcacggtgggtcttggtcttggctgtttagaattgaccttgcgtggacaaattccaagtcttcactcgtttttgattcgttagcgttcccttcacaggtcacagctttctatttacgaggtgaggtccctacgcatttgcagccatcttctctccttcctgcaccgtcgagcatccttccattcccatacctcgtgtcgtgagaggagagcatagcagagcagaacgtccttccatttccatacctcaggaaggcagctcaatccgctgcg

SEQ ID NO: 13686 - DNA, 874 bp, Zea mays
tgcgaacccgttacttggcacgtgacccgttagtgaattgcggacccgaaatggttaggtgggctagactgttcggttggtatgtcgtttgactggtcagttcggtgcgggtgaagcttcacctagttggtaataatcaattgttatcgattggattcgtttgaaaaaaaattatttaagaaatactttaacgatggtcttttcccataatagggtgagttctttgggaactcgtttcttggactacataattaagttttacatcatatcagaatgtttttgtagtaaacagttcacaaatactaatacaaatcttgcaatcaatttgtaataaatgcatcggaagagatattattatgatgctattgctttatcttttttgttcaaaacacgcatacattcgggaaagaaaactgaaaatattagcgacaacctaagaaaggtctacatacccatgcctggatctatctgtgcatggcgataagacatagggaaccaataatttatgggcaatcagttggacgttggcagatggagacggccaatggcaatcatggtcagctctcaaacatatgcatgccagagggcttcggatgaacagggagctcctctggctcttgtctagctagtcttggatatggagccaagctgtatctggtggacatgagaatggttttttctcccttaacagctaactcctagtgacttttgcacttgcagagtggtagagagcgtgggcgaaggagtagaaggcctcgccccaggagaccacgtcgttccgatcttcaccggggagtgcgagaaatgcgtgtactgcaagtccgacaagacaaacctgtgtggaacctaccgtgtggatcctttgaagagcagc

SEQ ID NO: 13687 - DNA, 854 bp, Zea mays
ggcctatatatgccccattatttctctacttagatgctcactaatcatatcaacaaccttgacataaataaattataaactctagaaaagatggtagataacaaggtcaatgcatccctctcctttagttcccatttagtgtaagcaatgcaaagacgcttgtatatgcgtttgaagagagagaacaaatgttacattatcaagcacctctgacgatgtcccaaacgtacaatagaaaatggtcatatgatataagtggtgatgacactttgttttttgttagggccgtggtgcaaggtacttggaaaaaaaataatgtgttgggcaatatagaaaagaaagggatcgataagttgtgtaattgtcgcatagtgggtattttctcacaattttacaaagaggttgcaaactcaagtttttgaagtatctcttgagaaaataaaaaatatggagctagacactagttttactttttttttccggaacaaagtttgtaaaactgccagtttggcttacaaagtggggagcatagttggatttgtggagtggaatagtcaaaaaaaaatcccagctcttaactgggcctgagtagaaaagataaggccgttcattttcagcccgtggaaaaattgaaaccaattgccagaccaggagcggtccgaattctctagtttccgatgaaaccccattcaacaagcaacagatccgatttttttttcctgctcgcgttgtttcgaactcacgcaacgcaagctgagcaaccgctgccggccgcgcacggccgcccacccaccagtccaccactaaagcctcacaccgccacagcagctgccgcggccgagccgacgacgagg

SEQ ID NO: 13688 - DNA, 1500 bp, Zea mays
gacgaaatcactactctagattccagctccagcgtggagctatagattataatataaatttaaatagtttcaaaatattttaatttaaataataaataaaatgatttatgtaaacgcattataaaatttcacaactctgggttcacgattttctggagcacatataataacttgcttcactaactttacaaaattttctgaagctagagcagttccatacaacaaatgtttttaaacacataacaacaaatgttttttttaaaaagtacaaattactcctcctacatatggacgatgttcatgcaacaccctaaagttttttaaaaattattttacctctccacctagttggttcaatcttacccttaacaaaatttgtctttttaaattatttatgtataaactaagttttgagtttaaattttgttagttagtagttaatgtcataacttagcctagaaaaatacattatggttttcgtaattattttaataggttaaggatcagataaggtaaaaactttagtggtacaaaacaaatatacaataataacgaataatttttaacatatatttttaacataagttatgatgtcctcaatcatcttagaaattatgaacatgaaattcaacttatagaggaatgaagaaaataaatcttctcctaataaattcatttcttcacttataagttgaatacaaatttacaaattcttctagttttcctagtggcatagtagtgccattttcatataacagataatacaatgacccaacgttatctaaaggaaatgtgctacgattaaatgaacaagaacagaaatttcaagaagggtaaaaagcataaccatcagcgcatcaccactcaggcaaaccttaagcaaactccgtccattttgcggctaccggaccttgggccatatgtgggccgggggggctcccatccgcggcggtccagcccgcgtagagcttcttctcctattctccttgagcacgggcattcgctcgctgtctgagccgtagaaataacagcactcgagcctatagaccactaactactgtggggaaaacgagattagcagcgggtaaaacgcacttacgatataatcatgtgattagctcttcttaagctcattcttctcttaaccactgcgcgtaatcgagtaccagaataatacgtctgaaacgttttctatagcgcaagcttcagttccggtaaaatgacctgcgtcctcccaatcccagctcgcaggcatccaattctgtgtgccatcactggcttcgttcgacgtgggagtactaaacaagctgcaataattcagcgcgcctttattcttgcaataattctaggacctggctgaatgctgcgtgcgaggtcggccgcgcgcctataaaacacctcgtcccgtgcctccatcaggcatccaagctcaaagcaagcagatctaagctccaggcagcgtcgcgacagagtgagctagtgagtagcacgacaacaaca

SEQ ID NO: 13689 - DNA, 1499 bp, Zea mays
ggaccgtctatagttgacgaccgttaactttgtcaagtgccagaagttcacctgaaaaatgctcggcaaacatatattttgtcaagtgtctttatctaacactcgacaaagcagttggggcagtgtactaagagctaaaacgaaaattggccggcgtgccttacgatgagcgtctgtcaggaatttttgggcaatctgaacctcacgagtgacgactgaaaggaagggaaaaaaaaactaatctaggttagtatattaataattaataagctaaggtaccaatcaatcatacaatagtactaccgctagtacgctgctgcctcgtaaccctacgctgtcctcgctgcttgatccatgagcctcaacatgcatgctagctccctgtacacatgtgcatcatgcatgtagaactgtagacggaaaaggaatgaggattagaccttttttagaaacctagaccctgccgaacaggacctaatggcgagattaccatcaccctagtctcgttgattaggatgatgaccaagtacgtagtagtgagtagtgacgacgatcatcggccggattaggcacagaaccttttcttattcctcctcttgttcttccttgttggtaattttaatgatgagagggttgctaactcgcgccagccttttaaatcagttgcggtcgtttcgcattttcataaacaggcatgtttattaaacactacgataatttatctttttttttttttgcatttgcacgtactttcggcattcttgtaaactttcttgcaacaaactgcaggacctagagctaattaagctttgacttagttaggacaaagcaaggttccgtttggacaccttcgggtgagcgaaaaactaaactgatttacactctaacctatcagcaaatataaattaagatataacacgagagtaaccagacatgacctgaaactagttctacaaccacatgaaatgaccactgctatagtagggacgaaataactggtcgtcaaggtcatggattgagaacaagctcatcgggtagttggattggatcggcggttcggcttcttctacgatacaatgctacttgcctgactttggcccaccgctaagttcaggccacattttgaagcgggctggccctagctagttatatgatgttagctctaggtataggttcttatcaagctgctttattctatctgatcactcatgcttatttgaaagctttattgttcttaggatccggatccgttattcattcaatggaacctcttgttggatattcaccagataaaagtcagaatatggttcttatgggtggtttaagaaaatacgttccaattaaaagaactactttttttatgtggtacactttctctttgtggtattccacctcttgcttgcttctggtccaaagatgaaatccttagtaatagttggttgtattcacccttttttggaataatagcctcttttactgcaggattaactgcattttat

SEQ ID NO: 13690 - DNA, 806 bp, Zea mays
ttgcattgacatcttcctttgggagagaaggtcgtctattcccttgccacttgttatgaagctcactagcaacatctagaaatgaaattcctatgccatgtcaaacaagggctcatctttagtgtaacgacccattgatagacgagaagcgatcgagaggaacagacttatcgctttacacgtgatgcatgacacacaaacccgatgttttaaaatagtagagatttataaaactaggcttttcaattacttttaactttgaaaactgttcactttttgtattttggtggttttgatgtcgatttcactgatgcagtgccacaccagaagtactgcagtaaattggactacaagtattttttgtaaaaaatatatatataataatagaaataattcaaaatttatgctgggctcgtcaatcgtcatggccttgctgtttcctgggctgggcctcgaagtcggaatggacgtcctttctttcgcttcccgtctggtccccttccgagttccgacttcgactcccaccgctgccggcggcgctggctaggtgaggctagcggcggctctctgcttcagccggagcgctactcggtgctgcccctcctcctcgcctcctgggtaaggaactctccccagagaccgggtcggtttctcgtttaatttgctcctcattttcatatcagtaacaaggggaatgcacactcgcagcctcgcaggaggacagagattctaaaattcagtacaaactgacgacctacacattcggagcttggcatggcgctgtcagtgtccatatagctgcctca

SEQ ID NO: 13691 - DNA, 801 bp, Zea mays
tgtcgagggaaagagttctaaggcgttgctctagatcagcaggccacccgttgtacctctaatcggcgtagagtcgaagagagattgttgtggaagactaaactagatctaaatctaaggataaattactcctactcctagaaattggaagaacgatgcaaatgaggtaaaattgataagtaaatttaatcggattgattgtaggggttcaatcagccgtaacccttcatctatataaaggagaaggtctgaacccgttacaagttggttcacgagttaattctgcaggttttgctaacaaaccccgctagaaatctagaaccctaactaattatatgcatgcgtgaaccgtccgcgtagtatcctaccacattggcacaagcacacatgattgcacacaagctcattgcatatctcctatctttactctttctaggcttgtgctaccttcctttgagcaccaccttatttcctattccatcttatgtactccttttttataggtgagggaatatactagattaccacggtagttgaggggtgcagtagaatttttttcctacctgcatgtgcgtgcaacaaagcgcagtccagataagccgtgggccaactagctgtattgtagtgcacagtacaggtctacagctatgcatatattattcttgttccttttgtcgacgcatcatccaccactaccggatcgccctcaaattccagttcagggggatgctaactcaaagcggcagcctcgtgccctcctcttacatctgaagcaagaactccgcgctcggtgcggcaacc

SEQ ID NO: 13692 - DNA, 680 bp, Zea mays
ggttggcgcgtggctggagtctcactcttctctttttatgtgctgcaactaaaatattgtctagaaacaattatagttgtctcctgtaaactctggttttgaaaaaagtatttttctcaacatcgtctgacatggcaatggacttaggctgtctacagcagcttatccactctatctgttatcatatgttttatttaaaacatcattctataaaccatgctataaacaacacgaaagaatattttatatgctcatatacatacatactagagacagccttgctaaagcttgtcaagagtcaagtcaagcaatgaaaaaaaaggcgtcaaacaaatttgccgaaactatgggcaccaaagaggaagacaaacagtcacaaccaatcaccggcgccaaaacatgcagcgcagcttcatgccttcatggcctcatggtcctgctggatatggcggaaaaactgctggcggccgttgcaattgcagccacattcaactcaggctccaggccgctgcaacccaagccgccagcagctgcagcctgccctcctctccgactccaacccaatccaatggctctccgcccctgttgtctcacctcacgcgctctctgccctgatctgccgccaggcgccagaacgacgcgctgctccgcaccgcgtcaggtagaatggtagatggacc

SEQ ID NO: 13693 - DNA, 1500 bp, Zea mays
tcgaagacctacgtctgtgtcaagcatctgtgcatctgtttcttcaccgccgctcgcaaggcagtccgcacgccgctcatcttctctacgtagctgcgctcaccggctcgcatgctcgcctcgccatcgctcgcctcgagtccgcctctgcgcgcacgccatcgttcgactctacacgctcgccgtcgctcggctcgcgcgcacgcgctcgaatccgcctctgcgcgctgctctgtgcgccgagtgcctacgcggccgctgccacgactccatagacggcaggtgaacatgccaaacacgcccaaaatccaccataccttaaattctatctgtcctccgccactatttacatgtgcttgtatggcacgatacgattggaaccttctattgatatgtgttccactcaaattatagttctctatttacataagtatggtttatgtgattttaggtatcaaattatttatgaatatattgttattcattgtgtaacgtaatttgaacaaaatacaaataaatcttgtgaaagttttcaattttttcttgagattgcaacatctcttggtcatttggcagcgaaaaccgccgagaagtagctgtttctcgagcgagaaattcaaaaaccgttgaatttgaaaacattaccattcggattctaacggttttcagtttttttcctgttttcgctgttgaccgagaaacggtagaaaaataggttcgtcaaccctctattaaacatcaaacgcatggacctcttccatccattcagtctgtggtccaccagtttcccctgttttgtggatgtgtttagattgggcgaggcaaacagttcgcttaattagtatttttcgtatttttctctctctaatagacaaatttcaaactaaagaatttgtctataaataaatcaagtcctcatatttattacactccttctatctctcaatttaatatatgtaatataatcttttctataacgtactaatatgttctgaacttagtaaaaaaatctgtttattgagggataagaagagtactacttgcttaatgtttattgcagtattattagtgtccggcacttgaagcgacaaccactacgaccagatcaaagtcctgaggatttgcaacgttggaagccggctcccggacgcgcaactgcgcggacttttcctgcaagcttcttctgcaaccgaagcaactcttcaatccagaagtggctgctccagggcggcatggcgccaaaagtctccagcccgttcctcctcggcctaccctgggtcgtcgcgcacgttggatccatcaaatcttccaatgcacgctgcgccggcccgggtcgtcacgcaagaggtaatgcgacgccgacgcgcacccattaaaagcaacccgtcacttagcgtctgagcgtgcgtgccagagcagagctcccttcttgctagcgagtagcgactagcgactagcgagaggtcgccggcgcggcaaaaatccgaaaggcgagccgag

SEQ ID NO: 13694 - DNA, 487 bp, Zea mays
ggtagatatttcattggtttatcagcaaaacatgatggtgcttgctctagtaaattggtttgttatccaaaatctgagccttgactgattgttcttgcttttcttatgatatttcatttcaatcaatggtatgtttgcaatagtgtggtactgtttaaatcaatttcaatcctaagttttttgttgtgtacacatgagatattgtgttcattcagattgacaatatgaatatcggttataaattaacatatcctgtagtgcactctcgtgatgccaatgtactcttggatacataattaaatattgagcagttaatttaaagggagtttgtttggaaattttgtaatttcaacccttattcaatgtatgcattgtttctcttttagagttccgcatttctgcttcgtctaagcctgtcaatttgaaacttctgtttatttactgctgcagttgtgatgagcgcattcagaagatacaaagtgtgaaa

SEQ ID NO: 13695 - DNA, 1500 bp, Zea mays
ccatctattatcaattttttcccaactaataaatacacgtgtgcactaataacgagggaaggggccagccggtgccaaccgctaccactgtagcaatggtaggaggcaccgatgtacgctctagcgggatactgttgcgttgccgtcacagagaggggagggggtacacggcgggcaccattgcacacagtctaacagtgctgaatcttggctaccaccaactaaaatgtgcatggccgtgtgtgcaatggcaaccacagtccacagcgagagagaaaaggcaaccgaaggcggcacgaaaagcagccgctttattcgccggcaaagctgcggctgcggctgcgctaggcgctagctagctgctgcgcgggcaggtggcaccaaaaaccctcgtgctttcggctgcccgcccgcgtggttttcacggagaagccgcggaaccgaatggcagcaggggcaagcgatcaacttgccaagcaacgcactgcagcactactgtactgcaccgcaacagcgcggcggcacagtagcgcaaccgaaggctccacaactccgccttcattccccaatccatcctcgccgcccggcgcccgcctttccccacctcgactcgacgcgacgtcggcccgacccgatcctcggcacggtgagcaccctcgtcccgcccgtcctctatcccccgcgccgtgaagtgacctatcgatcgatcgatcgttcatccgggcgctggtagtggtaagcttcggttcgatggaggtagctgttggccgcgctgggtctttgtccggccgcaactgcgggcctgcggctcgcgattggcgtcgcctcgccggcggattgctggtttcgtctcgtgatgcctcagtggtactacttgttagggtttgctctatggggaactggcctgtatcattgtggtgattctgattcgcatggtttatggacgcttgtagtagaaattcggcgactttcgtttcagcgtgaaaattctcatagattgggtgcaaagttgtgctgtttcagttggttggttccttcctcaagtgccttgcattacacttaaaactggtgttattactcttgaactgtgttgatgtagtcgtgctacattggtactcctagtggaacaaggtgtactcctagtcgaatccctttgtgcatagttttataaattggaagttttgctcacaaacgaaatgctgccacgggttacatatgctcctaaatagaatagcagtgctgttgtgtgatcggtactaaatagctttcagttttggttccgaaatgcattactttgttggtaggcactcaccataacatgtcactctgtgaaatatgctgttgggctatgtttgtgctgaaagtccttgttttttggtgtgttctctctcaggaatcttctattggataatgtggcgttattatcagaactccactcaccatcctctactttgactacatctgatccaattggactactggaccagctcttttcgtcca

SEQ ID NO: 13696 - DNA, 60 bp, Zea mays
aggtgctctcattggtatcggagccgttctcttcacgcaagggactaatcgcccaaagag

SEQ ID NO: 13697 - DNA, 203 bp, Zea mays
tttttgatgattacttgtgtagacatgatatgtatttcaatttctgatcctggatcagtttaattttctgataaaactgatttttgcttatcatttcaggattagcattgaagggttatccaatattcagtgaaaactagctactgaagaataggagtagcaatacctttgatgccccataaccccattcattagtttctgca

SEQ ID NO: 13698 - DNA, 1500 bp, Zea mays
aaattagtatttttttgtcagctataagcatgcatagagccaaaaagatcactaattttagttggcaccttgttctagcctacggaagttagtaattttccgctggctaggccacatggaacaaaaaattggtccattttttttgggttggcttaaaagcccacacatatttagttggcctataagaaattcttgtgcatgtcatgcccgctgcaccaccatgttgcgtgctccactcactctattgcactacaattgttgtcsagggaggtgattggggttggaggtgattggggttgggagtgtgggaaactaagcgcagagcgattgtgacaatgtgaacatgagctcctactcgacaagggagcaaaaggggtaccatggtggtgttgaatgcgattatcatgaggtgaaggttggtgtcacgataaatgatgctcgaatgcgattatcatgaggtgagggtcgatgtcacgatagagaatgctcggctgggacgtgtggaagcacaataagattggtgcgtcaaagcaagtcctaggaagttatgtttgcacacccaacgtagtgtgtgggaatggtacaataatataattttagtgcattgagagtgtatttttaaactatcaagattgggaagctacatacgtaattcaaaacctatacgagaactttagataagtatagggagctaaatatgtaatttgaaagtaccaagacctagataaaaacttaaaataagttcatatagctcattgtataatttaaaattatcaaaacttggatgagaactcgataccaattcgagaactgccaataaaatttactctatattaaataactgcaatatccaaaaggatgtagatattgcagcatagaaattggaattggaataagctttctagaattctattgtttgattgcatatagaattaagatttggaatctgagacctaattctatagaattggactataactagaaactcctctcaataaaaagtatcactcctctgtattgtgtggaattagatcacataattctaaactctaatttaataacatccaaacaatagaaataaaattacatcttattttaagccagggttgatttggtgttaaacttaattcaatttcatgttttctcgatatctaaacggaacacaaaaaaagataagtatgattatttggaggagataaaaagcccacggactacgggctaaaacgcttcgggcctgtccatttagccatcctaatattttccatgcccaacaacgacgaatatcaggcagcccagaaatgtctgctgcagggctgctgggtttctgatgccaagtggagcgggacacgaggacaccacaaagcggtgaaggagaaccaaggtaatcgaacccggaagcgaccttcttgagcccgaagcaaaaggcactgctcatcgatccgccaccacgccacaaaatcctctcctactccggcagttctgctcgccgccgcctccacg

SEQ ID NO: 13699 - DNA, 708 bp, Zea mays
gtgatgtttcttgttacgtttctatgtttcatacaattttttttactcccgtcgcaacgtacaggcactcatctaatgtattaagataaattgagatgtaaattagtttattaaatatccaaacaaggccgcaagggtgcccagccaatacgcagggtggagtgaaaatgctcattgtttacatttaagttagtaagttaccgtgaccttgctgactttacttgcagaagaatcggctgatcaggacccgttccagtattggtcatcagaagtaaaaccccaggaagtataatactcgcgaatggagttccgcttccaaagaaagtcacgcacagatctcgcagttcaagttggccttcgcgagcccaacaagaaatgccggccgctggagggcggcatcctgggagacgcccgtgccctctcccatgcattctctccctaacatgatcgccgagatcctgaccctacacgaaccatcctcctcgccaaacgtcagccattgcgtctgcaatatttgtatgacaatcttctccttcaaggcgtggcgtcgttgatcgcctccagtcagctgggtgctgtatgtatgtgtgtatatatatgtgcagccatgcaggatggtgccagcgccacatacaaacaccaaagcagcgatcgatcgatcaatcaaagctcgtgggccagaacatctcctgctccacgaccacgacc

SEQ ID NO: 13700 - DNA, 1500 bp, Zea mays
cgagctcataagatattgtaaaaagcacgttgaaatgaagctagtgagatcaaaagagaaaattatagatattgtttttttatataaatacaagtatgagcgaagttacggcagcatacgcgcaagagtttgcaaaagagaccgacccttattggttccacgagtcgcatatatgtcaatatttttactttttgcatgtaacgtaaaccaacatatccacatacttgtaaagcttcgactaccaaatttatatgaaagtaacgtttatagaaaattctccgacaacttacatagaagatatgttgattcacatgatcattcccatagtgccctttgttttataaggtgattaagatccaaccatattgaaaatctaaacatttctagtttgcattacaactagtctttctacacaaccataaatatcaatgagcaccctaaaggcctaaatatcaatgagctcataagatatttgtaaaaagcatgttgaacttaagctagtgagatcaaaagagaaaattatagatattgttttttatataaatacaagtatgagcgaagttacggcagcatacgcacaagagtttgcaaacatttcccatagtgccctttgttttataaggtggttaagatccaaccatatattgaaaatctaaacatttctggtttgcattacagctagtctttctacacaaccataaatatcaatgagcaccctaaaggcctaaatatcaatgagctcataagatatttgtaaaaaacatgttgaacttaagctagtgagatcaaaagagaaattatagatattgtttttatatgaatacaagtacgagcgaagatacggcagcatacgcacaacggcataagagtttgcaaaagagaccgacccttatkggttctacgagtcgcatatatgtcaatatttttactttttgcatgtaacgtaaaccgacatatccacgtacttgtaacgcttcgactaccaaatttacatgaaagtaacgtttatagaaaattctccgacaacttacatagaagatttgttgattcacatgatcattcagtaacaaaacatatatatatatataaatctttaaacagtaaaactcattgtgtgaattatgcatgccctatatagaacagagatggcttgtgtaaccctagaactaaaaaccggtcacatgtaccaacccggtcgggcaaggcccttatggttaaaaagcaaagggaaaaaaaaacgtccccaaaacagcacacagctctttggctggaggcggtggcagggggaatctccgtggtctggtctgagacaacctcaggcttcccacccacggtttcccacactcgccgtcccccgcttcccaccacccatttcatccccccagcaaatccaaccccacccctctcactctcgtctcctgttcgccagagccacctcgctccagaagctttcctcccctagatctccctcccgtgcctggtcgcgctgccgacccggcc

SEQ ID NO: 13701 - DNA, 138 bp, Zea mays
cgtacgtgatccgatccatcgagcaaggggcgccgccggccgtgctgtgatacgtacggcggtagtcgtttcatttgatttgatttgatttgttcctcgtacgtctcgtcgctgctgctgtacgcgcgcgcatatgtg

SEQ ID NO: 13702 - DNA, 151 bp, Zea mays
cccgttccttggttcgtctgcatccatcgcggccctacgttcctttgcagcctttacccacggcccagcctctgtcgccgttttcgagcgaggcaccggcggccgcatagaaactcagcttccgtctctaaaccctcaaccctagcccgtc

SEQ ID NO: 13703 - DNA, 315 bp, Zea mays
tcttgtgcagttatctgcttgtcccattttccttattttgactgatgaagaattgcagtcaatgtcatctattactgtgtcgttgcatcctcaatttaggccctgttccaatctcgcgagataaactttagcagcttttttttagctacttttagccatttataatctaaacaagagagctaatggtggtaattgaaactaaactttagcacttcaattcatatagctaaagtttagcaggaagctaaagtttatcccgtgagattgaaacggggccttaatcattactgttttgttatcttttacagttgaaca

SEQ ID NO: 13704 - DNA, 1357 bp, Zea mays
tttggtactatgtcaacagagacaaaaagagactcgtgattttgaaccacggtcaagaacagataagaaaaagtcacagaataaaattagggttagaaccctaattttttttaaaaccgcgtgaatgtgcatagatgcactaaaatcatcacagaaaataacagaaatatcgcggggcccggatctacgatttttttacctccaaaactcgatcccattacaagatatccatctcatacatttaatcagatcgtaagggattcgagtaaatgaggactagattcgagttcaattgcatagtgcaaatgtctagttctccttggcggccgagtaatagtgcggcaagtagaaacgaaaaaaatcaacaaagagcagctcggcgcacaataacagagagaaggagagcaacttgccaagcggccaaagagagcaccgtcggccagctcctagcggttgcagctgggagaggctagtgcaaatgcttgtacgactgaagtagaaatgaagagaaagagagagagaggatgtatgagcagggtgcggtcgacagtcggccaggagccaagctcattggcggccggaagtgtattgcggctgggagagaagaaatgagctaggtttccaccggtcaccccgagattttcgtcttttataaacctagctacagtagctcgagagatcctggccgctggttttgatccaacgacacaggatgagacggggggcgctggccgccgcgtgggccaaaagcgcagcccaggcccaggttgtggcctcggcgcgcgtcccccctctcctggcgcttaagtgggccgttcaggctgggccttaaggccggccaggccgaaatggcttcaaattttttttctgaaattttattttctatttccagaaattagaaacacagaaaagaaattagaaaaacagtgcagaaaatttagaattatatttttccagttatagaaaatttcagagatatttatggactatttttttattccgttgcgtactttggtacttttatttatattttatgcaattttttcagttaattatgaaaccaacgtggattaattattgtttaaattgcatagaattcagaaaattttatggtgattgaatattttaaccaacgttggatattgttatcacaatttaatacaagtttatgttttctagatcatccaacgatggtttagaaattttgtgatcagaaattttcatagatatggcatgattattatttgaccaacgttgaatatttaattcatgcatgttctatgattcagtattcagtatttatttcagatgtcctaaatattttctattttaattttgcaaaggtgctcataccgcc

SEQ ID NO: 13705 - DNA, 547 bp, Zea mays
tgcagcagccagcgcggcgcacggggcacctgctgcttgatcagtattcactgccacatacacatggagcaggacaacaacttgacggcaaagaaagagacttgacacgctgccatgcatggttccttttcccagttcattgtccttttctttaatctatggggtttttttgtttaggattataatatattcagattatataatctaatttatttttgaactattatacaaacaaataggcccataatctcagaaacggggggaggccggggggttggtaattttctgaatcgatcgatcggtccaagtagtggcaaatgccagattgaaacaagtgacatttcaaatttgtgatgcaaccatcggacgctcattttggcccaatcgatcggcacgtcgcgaacgcgacccaaggaagaagagcccgaaaatttggggaaagctagctagctagctatatacaagcagaatgtagctagaatacagagtactacacaaacgtacgtacgcacgcacgcctagctctagctaaaagcactcctccggg

SEQ ID NO: 13706 - DNA, 541 bp, Zea mays
ctggtgaatttgattcgcgttatcagcaatgaacatagagctagctaagaggatcaaactgaggggagcgttcattgacctggctgctacgcggaggcctggtggacgtagcagcagcaaggccgcgtggatttgtcccatttgttttgtttaatagtaatataatcgtggacagagcagaggcttttgcgtgtgcgtttaccagttgcccatccgggttacatctcacggaatctgaggctgaggcgacggagcgcaagcaagcaagcaagcgaaagggcagggctgcctgccacacaagagacaagggaagaggagaagggtagacgagtagacgactgtgatgaggctagaagaagagcaggcaggagctataagtaccccgcccccttccaccctctccttccacctccctcccttgctgcctcatccattccagagctgcgaagacagacagacagagagaaagagggatcgacggagcaaggcggggccgtgtccggtcacacacgagcgagccctctcggccgcgcgtttgtga

SEQ ID NO: 13707 - DNA, 1500 bp, Zea mays
taattatgcttagataataactatctttacacatgtattaaatatcagctattataactacatgaaatgaagtggttaggttcgttctttcacttaacaggaacatagcgagttgtcaattgtagtaatggtcatgttattctcactacttaaaatggtcgtaagcgctagccatatttcggatatgtgactattggattcatttctttgtatggtgtaatgtttacctttctgatttgagatgtgaatgcatgtttgaactcgtatagagaacgatctggttgaggaacccgaagaactcgcaggagaagcccctgagcagcagtcgattggtggaggcaagtgtcccttgacctatctctgtcctatacattctttaattcacctcccgcatttcacagttatacttaaggattgactagcttttgttatccatgtccttgtttacctatttgagttggattattattgtttagctttatgctattgctcaactctaatcaatgaacatgatgagatttatcaatgatacactgttttcccatcctttattatgatgttatacttgtggtattcaagggggctcgagcggtttctcgagtgcctctccataaggacctgttcgttggatgaccgtccgggaaaacagtgcaaccatgagggtggaatgggatgcccttagctgaataattagaggaaccggggtgtagttcgcttagccgtcgtgccgttaatggggctcggtgtatgcggctcgctctgccaaggttgatttgtcccttggggaggagtgcggtacatttaggaaacctaacgggcggctacagccccggggaatctttgtaaaggctacatagtgagaccctgcctactcaccttgggagtgttcaagggtccgtacaacccgaggcaaaaagggaatcacggctcatgggtaaagtgtgcaacctctgcagagtgttagaaaactgatatatcagccgtgctcacggttatgagcggccaagggagctctagtgattagtggtacttgatcagagatgttcggattgcaggtgacaatgagactgatggttcttggttttgactctggtaatggtaagtggtactctttccatttggaaaggagtacgtttgggttaataacgtgggttaactctaaaacttggctttctctactagtaataataatctgaccaactaaaagcaactgcttgacttacccccacataaagctagtccactacagccaaacaggacacttgctgagtatgttgatgtgtactcacccttgctctacacaccaacccctcccttccccaggttgtcagcattgcaaccactgctcaggagaagatgaagccgtggaaggagacttccaggaattccaagactacgacgagttctaggcgtgggttagcgacaaacccccagtcggctgcctgtgaaggccgcgtttatctatgtttcattttcgcactttgatttattgtaaagact

SEQ ID NO: 13708 - DNA, 1500 bp, Zea mays
tggaccttcatctctaagactagatacatgcgacgttgataccgatcagcgtgttagaatacgagtcaatatcgatgtagcgacgtgcacggtcaacactaactgtcgcggcctcatcggtaatccgtttggttagatggttgacctggtcaatatcgaccagcgtgttagaatatgagtcgccatcgatcccgatcaatcggtaccgactatcacattctaacgttatagctcttgattggttgacgctattttaaccatttagatttcaaaaaataaaaatatataaaaggtttcmaaagtccaaacttgttctatttagaggagggtgtttatgttcattcacacccttcactctccaattcacttgcttctctttgatttgtagcctttcactctatgtttcaatatgtaaccaaggtgaaatctaaacttttatacattcactaactcactcaatgagcaatcttcacaacgtcccaagacccgtataagacaagttctcttcatggtctttcttccatccatcatcgacagcaagattttcatgctcatacccattcactgggactgcaacctctattttcatatccatatcctcctcttgctttgtatccatacttatcattcttcaatgctcctccttccactaaaccacctaccatcgatgttcttgcttctacggttctaccattgaagctcctaccaccaatgctcctccttctcaaacttttggattagtacattgctaacatggacaatgaaatgaaaaggggtcacaattcgtccgaaaaaaactaaccaaacaatttaaatgttttataatttatttatttttctttaaactgtgtattttttttcttaattatgtgatcagatgaatttttttgtccaggtaaaacatgatgtggcgctgaggtggctgacgtgcactaatgcaccagcatatagtcgatagctaatgagtatatcaaaatatattccgtaaacgtaagaaagtactctgatataaaggtaataaatacaggagatcgtcgaggcgagacacagacaatgcacacataatccgctttgtcagttaacctccggcgaaccgcctcccgcgcgtttctctctgccggccctccacatctctcgcacccttctctctctcctcgccccggtcgactgccgatatcgccggcctcgatcccttctgcattcacaagccgcgcgcgcgcgtgggatcatcgaccagcagcttcttcccctcgtcgccattaaattcctcctcccggccgaccccgccaccaccgtctgcgcgccggccggcggtccgccactctgtcccgtccgatttcacgtcgcagaagcaagagagacaagcgtcgcatgcaatccaattgccttgctctggacgccgcgccaaggaagaagacgacccgttgggcttgcgacccagacacggcggtggcgatcggtgtgatctcagctctcactcttcttgtcgtcgtcctcgcg

SEQ ID NO: 13709 - DNA, 967 bp, Zea mays
tttccaaatcgttgtgacttttagagcatctccaagggactctattttttattttttatttgactctctatttacctcttcataaagattatactctatttatagcatatcatttcaacagactctccaacggacaagttagttcaactagcgagagtggctagccaaatttggctacagaggaggccattttggagagctgggtggcttggcgagttggatggctagtctgtcggagagtttttctgttaaatagcgaataattggtctgacgagttatttggctagtctcttgaagatgctcttatatacatgtatgtctataatagatgttgtgtttttttttctgagtaggattgcatctacattgtttgtatgaattgaatatatatatatatatatatatatatatatatatgagattggttatattaatcttgaatatctaaaaaagtaattagacggcgtttcttttgaaaaacattatagaaaccattttgcaaaatgttttttataatggctttggttccttaaaaaaaactgtctggacggtcaagctaaagccaaagctatttttttttaaaaaaaatgtcaaatccggacctcagtatcgatacactttgaaaaaaaaaactctctaaacttgaatcctagatccagcactgaaaatcgccaaaacaggggttgcatttggtttcggcccggcccactgcgccctcaaccatgacgatcggcagccggccgcgcaaacggagttcggactttggaattgtgttgccgaacggttcgagtcggtttcggccttcgcacagcagccatcgtatataataagacgtcgagacggcggcgaaactatcctcgtatcgattctgtttatgctcgcataatcgcattctccatcgtgccaatggtcgcgacgacccgttccaagacacggctgggcctaggctcacggctgcagcacaac

SEQ ID NO: 13710 - DNA, 92 bp, Zea mays
agtgcagagagttagcagatagataatgtactgtgctagttagtacatgattgacatatacttgtggtatttgttttccgtcttttactaac

SEQ ID NO: 13711 - DNA, 489 bp, Zea mays
agtagttggaaatgctcttcattagctgcaacccaaagttttgcactttttcgcccgttcgcattgaatcatttcccacatataaaaaacaagtaagcttggacaccagtgtaataatactaatgggcgcccagatcttaataaaaaaattcttatcctcctccgattttatgcgttattttgtttgccgcgcccacagaaataggcgccagttcatccgcttccattcctagttctcaccacccagaagtccacctccttgttgccttcctccaatcccaaatctcacctccttccagttccagctatcgctgctcgtgttggctcgcctcttcctccattcagtggctccttagatcggctcagggacacgcaccagcgtattgtgtcggcgccgaatcttgcgcgcatttcgcgctattgttgccccggaggagtggtttggatccaagaaagtgatcggccttcttggttggatctcctcccgca

SEQ ID NO: 13712 - DNA, 300 bp, Zea mays
ttaccggcggtggcgtcgctgcggcggcgcgaggacgaccagagtagtggagacgagggggaaatgggtttagggcttaactcatctgaccgtggcaccgtgcggcacgctgggtttccaggcccagacttgcggctcaagccaactgccatccatggcccatgggcctgtcgggtatcgactcggcctgctgccttgactcgcatcctcctccacgagccacggccaactggttagttattccgtgccgtcccaactcacccgcggctccgtgccatccgtcgccgccggcgcaccgcg

SEQ ID NO: 13713 - DNA, 300 bp, Zea mays
tcgcggtgcgccggcggcgacggatggcacggagccgcgggtgagttgggacggcacggaataactaaccagttggccgtggctcgtggaggaggatgcgagtcaaggcagcaggccgagtcgatacccgacaggcccatgggccatggatggcagttggcttgagccgcaagtctgggcctggaaacccagcgtgccgcacggtgccacggtcagatgagttaagccctaaacccatttccccctcgtctccactactctggtcgtcctcgcgccgccgcagcgacgccaccgccggta

SEQ ID NO: 13714 - DNA, 378 bp, Zea mays
ccgtacccaccttctatcgggtaaaacccgtcgggtattcgggttacggatatccattgccatctctatgcacgtctgcgccagcacacaaggtctcaacgaggtggaggggagccgtctgctggcctggcaggctgacactgcagcactgaccggcaatccacttccgggtctcgcactctcgcttgcttcgccggcccgacacattgattgattgatgagaggcatgtgaggccagcatttctcggcgcgccgttgtccgcttgtcgctagtcgctacccttcgccttttctgtgctgctgcgtgactgcgtctcgtgtcaggctgtcagctagctttggggttgggggcggggcagtggggccctacggccggcc

SEQ ID NO: 13715 - DNA, 240 bp, Zea mays
ggttttatgcgtagtgtcgttaattattctacacttgacatactgtttatgttcagtgtgcatgttattattctccacttgaacaacatgttgtttgtcaaaacattttatacacgcacgatttgtagtcatgcataayagggaactatgttgaaggtycgaatgctaaattagtcactaactctttgttactgaactaaggttgctgatgtgtggtcatgcggagtgaygccatacgtg

SEQ ID NO: 13716 - DNA, 120 bp, Zea mays
ggtgcggctaccgcgctccctccagccccgtgttccgttccgctgggtctgccttcgtggcggcgtggtttctgactgcttcaccctgggcttgcttttgcgggcgcagatcgggccggg

SEQ ID NO: 13717 - DNA, 112 bp, Zea mays
aatgaccaagaagatggagttaattaattatcatccgcccgggcgacccagtttttagtcgagaggagttaattatttatatctcgataactaataagaacatgcatgtgtg

SEQ ID NO: 13718 - DNA, 1262 bp, Zea mays
ctcaatgagatgagctactagtgttaatataattcgtggtcatagatagatagccagagtaccccttccatagctattattttaaatcagagtgagtgtacatattactctttaatctctagtagcatataacttgtggtaacgataggggtggcgggatcgtggggatgagagatgaggattatctaaataatattgtctattaaatttaagtgagtaaatgagagagaattatccagtgatttgaaccgtttgttttgatggtgtgtaattcgtttgatggatttaatagaggctatatgtgtaggagtgattttgttaggtggaaatttcaaaatttaaatcggtggattatacgatggtatagattatccataattcgagtatggcctaacaatgtttgtaggagaatggacaagaacctcaatcagcgaaaagcttcatggccccccctgcctattagctttcaacctttgcaccgatcgagcggccacttggatggcgtcaccaccttcctcctcctcctcctctttttggcagtctcagccacaaataatgcgagcaactttaatctgtgggcaaatataattaatggacattgctttgcatacgactccctccctccctccctcgctgtatatgatcgatgaacaaggacagagcgccacatccgattagctttgatgtcactgtatgtgtgccagtcaccatatataaagtagtgcaccctcccagcaaaagatttctgcataaattacgccctacatgcgtgcaattaataataatctttactcgacaagttaaaagtggtaaccgaaagcaggagaatacaaaaaaaggcaagttaaataggagtattctcttgggaattgaaaataggataacaagctaagtgttgtgtacgtacaggaacaggagaaaggatctacttacaaatttaagccaagcacatgccaccaaactctactcgatcgatccacaagattctcaaaactaaaaaagagagagagagagaaaaatggttagaatataaaaatgcatgcacagctataatatggtggaccatagcgaagtcttctctccmagtctcagacgggatgagagtatagagctgtgtgcctgactataaaaggggcctcaccaacccaggcctagcaaaccaaaccaaaccaaagcatcacaagcaagcaagtaatataagcactaactagcaaagaagaagagaaccccgtcgagcaagactagaagagagagcaataatc

SEQ ID NO: 13719 - DNA, 66 bp, Zea mays
caaaccctaaccctagcggcccgggcgccgcctccgtgtctcgcccgcccgccgcgccgggccgcg

SEQ ID NO: 13720 - DNA, 723 bp, Zea mays
tgcaggatcttctcataggcccaaaggtcaccattgctgtcaatatacctaatccgaagagaggttttcgtgatttcatattacacatgctgtgacttctctagctctgatagagtccagtggcctatgtccttcaccatttttcctggctgagcaacatgcaatatctacaaacctcttgtagaggaacataggccatggtccaattctcaaacaccatgtaatgacataacaaatacaactaaaatgtttagatcatggcagacaatgattctagcaacggaaacctgacttgactcactctcatcagttggttgccgatcgtggctaatatgaggaggttattactagtaactctcttcacactaggctggactgcaggagcccaaccggcctacgaagaatcggctggattttgtaggcacgagcccaaccggcccacgaagaatcggcctaactgcagcccaggatctctgcacggaagcagctgctccccctattagtccttctcactgcgttcttccaagtgtctcccggtccttctggacgcgacagcacaccacctctacgaagcatctcgaactctcggtgccgctcaatttgtacccccaatccccttccacacaccgcctcgccacatcgcagagccagatcaagggaagacgacgcagatctcgccacgcgaacacagttagatcgagggagtaagtgagagtgagagcc

SEQ ID NO: 13721 - DNA, 1500 bp, Zea mays
cttccctccacttctcttctcctgccttttttttctgggccaaagtgatcatgtagtatctttcgcttggagattcttttcagcttaaattactgttggtgtagattaagcgtgtctggttcctggttttaattacttcttgccttgacagaggaaaaggaaagatggatgcaacttcctttcctgtttctctctctctctctctctaacccatacatagctttcctttgctgccgtgttaaaggcagcatagcaacaaagcgatttcccgttgcacccggccgttctttcccgttgcacccggccgttctttacgccggtgatgaagaacgcatttaaggtcatccttttcggctgggctttactaccgctcttttgcagcgtgggcgcggctgcgacttttgtttttaatggcacttttcttttactacagtaattaatcatgtggttcaagagtcctcttcatctctttcatctttgctcctgtacttattactgcttctgtacytgcactctgttcacctctctcgctacggagcaaagatgcatcagccgtccttcctagttcagaacctgttttgcgagtaccggcgcccacgttcttgctggccactgtccgtttgtttgacaggagacggcggtgaaacagtaatactagctgtttatcagcctttcagcttaagcaaaccaagcacgtacagtcagtacgacggtactgccctgtccctccttgtgtcgttaagacaaggaacgcctttagatgtgctgttgatggatacagtgtacgccatggatcatcatactaccaagcaagttttagggtgtggtgtaactgcatgccatttatatggtgcccctggtacttgagaggaattaatgtgctgggggggggggtgctgaggacggaggttagctgtgcctgctcccatttggagggacgaagttttatcctgtggttactgcttgtcgatgtcaagcaatttttatgtgagcacttctgcgccactcatgcgtatacctactacctccactactccagttttaatgttttatttttgagcagaggatgatccatagaaaaaaatggagtttaatttgaaacatcacatgggtacttgtacttctctatgagctgttaatcacttgcaatatttttatttctaatttgattgatcagccatgaaatcacgccacatgttcctcagttgattgtatgagcatgttacatgttccttgcttgcatgtatgatctccgtggcaaattctgaaaaatatagagagaacatgtctctctatattttcagctctttctgatgtggtctgtcagtgtcaccagagacagccaaccgggatttcttcagttttaaagtacagtatatggtagccggccacatttggctctctttgggtctgatctgttatatgttattgctgtgctgcgcaggtactctagagattagtttggccgcatcctccgtatcttctacttcttgaccaggg

SEQ ID NO: 13722 - DNA, 1333 bp, Zea mays
agttgtattctaccatcatgtccctgcccgtttgtatttctgtttcagtttggggtgctctcttcctatttgaaccaaaaggttccaggtccagttttatagtcaattgactattttatgataaagctgctggagttagtagttctataaatgtattgagtttctagcattggaaaaatcaacgaaaacttaagggttaacccaagatcactcgtgccataaaatactgtggtcaattcttcttagagttacctttgtggatttctttaaatgaagtgaaatcgatgctatatatatatatctaaaaaaactttgttcaaactatgtttgcttgaagtcacatgctcatttaacatgcagcatgagtattggacccaatttcttttttgcagtttcagcatgattgtatttctttttgaggaaaggggagtgcaaccgagtacggggaaacttacaaagaccagaatcggtgtcttaggcagaatgtgcctagcaactgaaacaactatcctattcagaacgcggatctctgaacaagaatgagtttcagcatgattgtattgatgaaatgtctttatccaatcaccatgaccgcacaattacttatcaaatagtttcatgggaagaattaatagctttggtagatgcccatgttctgagaaggctacagcttcctaatgcaaaattgttaatgtgtgtatcattacttgcaagcttacactcttcttgacattgcatctttcaaagggatatagaaatggattggctgcatgaaaaaaaggcaatagcagtcctatttctacagaactaggtaaatcgcagcaatctatgttggcctgcaaaaatattctctgtcgtctagaatgcaagtgcctatgaatgggaaatttttgaaatttaattgcttcagcttctagacggcgacattgacgttggagccagccgcgatggggtcgaccatgagcgaggatgccgagacagtggcccggatgacgattacattgctggtgccgtgcacgaacctagggacggacgcctcgcccagcgggacggcgttggcggtcgtggcgaccgccgtcgcgtggctctcctcccggctctagcagaagaagcggtgcccccctccctcactcttcttggccctgatctaatctgccctctgtgttaggataggtttgactgggtgacactcgatctatcggattcggatatgattttcttgttgttgtcytgtgcagctcgatggcttgttggcgatggtgcagcctgtcctctccaatgatcccaccgtacagttgatgccttgcatcgtctgatccctaggttgtgtggt

SEQ ID NO: 13723 - DNA, 552 bp, Zea mays
cctagggatcagacgatgcaaggcatcaactgtacggtgggatcattggagaggacaggctgcaccatcgccaacaagccatcgagctgcacargacaacaacaagaaaatcatatccgaatccgatagatcgagtgtcacccagtcaaacctatcctaacacagagggcagattagatcagggccaagaagagtgagggaggggggcaccgcttcttctgctagagccgggaggagagccacgcgacggcggtcgccacgaccgccaacgccgtcccgctgggcgaggcgtccgtccctaggttcgtgcacggcaccagcaatgtaatcgtcatccgggccactgtctcggcatcctcgctcatggtcgaccccatcgcggctggctccaacgtcaatgtcgccgtctagaagctgaagcaattaaatttcaaaaatttcccattcataggcacttgcattctagacgacagagaatatttttgcaggccaacatagattgctgcgatttacctagttctgtagaaataggactgctattgcctttttttc

SEQ ID NO: 13724 - DNA, 247 bp, Zea mays
tgttaaaaagtcgacttagtggtggtcgtccgacaacagagggtcatgttcgctattatgttgttgttcatgttagtcgtctcactgttatcagtcttgtcgtgttacaaaataaatatgtcgtacgcataattttcccttatgaacaattttgcaattattcgagttgaacatgtatttgaataatcagagttgtatgtttgtgaacaagtcaatctgtgaactttgtgtcacctatgctacatga

SEQ ID NO: 13725 - DNA, 672 bp, Zea mays
atgctacccctcgcgtaatagcatctccaagagactagtcaaatgagtcgtcgaacaaaattttagctattcaactgcaaaaataactcttcaatagattagttatctgactcatcaagctatccgactctctaaattagctctttcactagtcaaatttagcaatccatttgactagccaaactagatagatagtctgtttgagtgagatactgtatacggattgtaatttttatgaaaagataaataaaaagtcaaataatgagaaaaaaatgaggagtctcgtgtaacgcgaggctaatttggatggccacgatttggtgcactgacaagagaaagtcctggaatggatccaattcggctgaaatcctgcttttcccatgcagtactgcagcggatcccgatcccatggcacacggtcgtttgaggcattgcgagtcccgagtcgactctctcccgtttcccggccgtccccttcaccaatccaatccaactccaattcgtcctccggtcctccccctcgaggcctacgcacaatagattcgatctcgagtcctcgaatcctgccttttcctctggtcaggaaagcatgagcttgatttccggcgcttctcgccgtcgagctcgaaccagaagataagaagaatccgctaggggcgagccccatagaag

SEQ ID NO: 13726 - DNA, 1066 bp, Zea mays
gtataataatgggctctaaacctaattacatggcatttttgtttatgtggaagggagaggcatcaaaaagtaaaaggagttggctctcatgagttagatgatacatgggctttaagacaaaatgtgaaaatgataaaagagggagacaagagatttatctaaaagctaaacttagagccagctttattatataagtgtgtttattgttggctctaattgacatggtaaggagttagagccaacaataggctctattattaaatcagaatgatgaatttaattaccttcacttttctcaatgtccactctcctataggcaattaatgtggatgctagtgcttggcgtgggtatcagtcactctcagttccagttcactgtcacactcacacaaagcagctccggtgaatctctgtctgcaaatagtgtgtatatatatataggaagctgtgacagctcgatttcttgttgtcacatgcagaaataaataaaggcatatgcgacaatgactatagaaacatgtaaacgacaggctcacaagtccaaacagaaaccaagcacaaggaagaacagcataccatcttgttccaagagcactgttctttctatctataccatcatataacacacatcaccgctttaaattttgcaaaactcactcgatcaacgtaccaaatcacccgacacgcactcataacctccgttaaatccacaaaacaaattgcacttagaataacgcaacatcaatatttaaaagtgagaaatcaaagctcctcgtctttgcagtcgtctagcgccaagaagcaaggataacgttctagctttgggacataggccgttgaagatatgatcgatcagacggggcctagatctaatctagctagctagcaagtgaccatatcttatcctttgtagccagtacccaccatgccgccgccatgcgtaatgtggcgtcgacgtcacaatatatagggtagcccaccagctagcctccggtcgtggcacgccggccggccggccattgttcgttggcagcgagagttggagcgacgggcaagccaatccagc

SEQ ID NO: 13727 - DNA, 899 bp, Zea mays
ttgcataggcagttgcagcatgagttattggctgcgaggatggaaaaaagagttagctatgaatgctgaagtaggaggtcagccaacaacttgtggcgctgcaggtccgagtattcataatgacaaagacaacggtccaggtataggcaaacctcacagccttatggagcgaaacgcaacagcacgaacctctcaggtttgcatttctttttaaaaatatttttctttgtttttgaacattgtccatgctgaacttgctttgtctttttagattgagtttgtgcttgtaatagctagcgattgtttccattgcgattgaaaatgatatcagcacctatatcatgtcaatattttgcattaaacattgggtgtgtacatttttgtattattctgttgattgagtttttagtatgaattattctctacattgctcctgctctgcaaaatcggtatgacatgtctaatagctgtaggatttgtttcactttagtaagttagttactgaaattaggacttggaattacgaatgctctactacggtccctcttcgcgtgacacttaaaagtaaacttactgtagtctaatttgagctcaatcaaggcgcctcataccgttctagataggtagcttataggatagcttggtatcataaccgcaaaatctaacttaaattgtttatggtcgtgtttctcaaaaataaaacgtttgtttgcagtgggaggagtcacatggtcttgatggttcggaaccaccatcaccaccgagaccgtgcttgcctagcccaaggagactaccaccttctcctttgccaccgcctggaaacaaaaacactaagcggagaaagacaaggaggtggagcttgttcgaagaagaaaccttaagaaagggtgttgaagagt

SEQ ID NO: 13728 - DNA, 1500 bp, Zea mays
aattgataggataggtctgcacggatgtgttgcactgcatgtttcaatcaagatagttaaaacagaatgatcttcagaaaggagaaaaatctgtttggtgagccaggccagtggctgatcgctaacgctcacctarctcgttcaagccatgcattcctcaacgttcccatcgtcgcaactcagttgctcttgacattttttgctattatactgttagtactcagcaaaatggaaaacttttatggtccaaaatatttttgtaggcttttcaattagtctacaaaaattaaataatttctgtcggtcgagaagcaaccaacaaaaactattaaatttgaaataaagatggttatttaagttatgtaataaagaagtcatatagcagcatttgatttgaaacaaatatttgaaaataatactttgagccacgttgagaagaaagcaaagtattttcatttttgggcaagccttatgggtgtcgatgatcaaatgatagtaataagggttggttttagattaaataacgaaactcaaatcagttttggtaatataaataaatggttaggacgtcatgcttttaaaacccgtcacccaaacctctctatatatacatactatggatggagttttatttgtagtcttggacatatcattaaacgcgtgattggttgtcagcctaccgcacgttggcctccctcgcttctggctcaccagcgatgccggctcgccacttctccagaggtgcaagcgcatgatgaagaaaaagcctagactgaatgagtgtacgcaagccgacatcctcacatacatgaaacccaatcaaaatatacaggttgtatctgcacagataaccaatcacgtggtaaatggttcctggttgtaggtttgagtttgtaataattagtccgattttgttttcactgttaaaaattgattgaaccactaaacttatatcatatatagaaaaaactagttaaaattttaaggatcttttcattttcatcgtcgccggtcagcatcagaccgcgacctccgatccaaactctgataagcttcagcggggcatccgcgtcatttcgcaccaaccttgttgttgttgttcttctatttcttagtatcatagcacagtatttcgtgctctcgcttcgctcccttaatttatcaccattcctaatttattctatttcttagtatcatagcacagtatttcgctcgccccgatttcccgactcttcccgtgcctcagacagcatcggattgcttgatctcgattgtcagaataagattcagcgcaggtttggattcaccgaatccaccgattgcttgcgccccgcggtcgcgcgcggcggaatttcggccgccgccaattcgggcctctccggaagggtgtccccggtgtggttcgcctaatatccgctgccctcgtgcgggactcctcgtgattttcggctgtgcgcttggcttttccagtcccgtgttgtggttccagcctttcagggg

SEQ ID NO: 13729 - DNA, 220 bp, Zea mays
aacatggcctcgtgtttgcatatgccagtatgccaccgtgtcgagtaatcaatcatattactgcttgcagggaggaactgtgtttgatttttattttccatgcgcaatgcttaatttaggtcaggaagtccaaagtctctcccattgttttcctgtaagagctaagcagtaccagatggagaaccttatatttgctggaacatgaataaaagcatttgac

SEQ ID NO: 13730 - DNA, 749 bp, Zea mays
ccacaccaaacacgcctgaggtctggtttgtggtttggcacggctctgaatggctccatgcagcgcaggagcagccggaggagcggggtttggacggccgggatgcgtcggcgtctgggcggcccgagaagacacgcaagggtggtccagacgcggggtgcagtgccggcgccatgcatgccgtcaccggcaggcagggcaggcgctcgcagtcacagtggtggagagtggaggaagcggcggacaggcggcggtgcaaaaaagattcccggcgacacggtgagggcgggggggacagacaggcaatgcagagttacgggagggccccggctggcgtgggtggtgactgactggtcaccggaccgcgcggcgcccgcgaaaatgacagcggcgagcgaggtgcggtgtttgacccacttagaattataaggcgcttgttgcgggccgtgggcgatcgattacagcactagcccccccgcctgccttaatgcccgcgcgccatcacttgctggggggagctctgccgagacacgcacgctgctggagataggcatccagacacggcaccaccagtccaccaccaccaccaccaccaccgtgacgtgagtgcccgagcgcgcggccgccatcaggctcccccgtcgtcctcgccgggcggctaggtcagagccgggagaggcgggggccggcggcgctaggctaggctaggctaggcagcggcgtacgtgcgtggccgccgcgcgatcggc

SEQ ID NO: 13731 - DNA, 590 bp, Zea mays
gagacagttcggaggagaaaatgtgaatggcagcaaggccgatggtggtcaggtccagaaggaggatgttaacggtggggctgatggtggtaaccacggcctggttgtcagccatgagacacacacggccagtgagctacaggcgttcgcacctactgagctcatggatgagcatcaggggatggccgtggatgctgtgctagagccgatggtggataatttcatggtttcaggtacaccggaaatggagactagggccgccagggttgagcgccttgcggcgatcccggagacagagctgccatctggtcgcaagaggagatcttgtacaacggatgagcattcgcttgcccgggcggagcacctgaaaactgaaaggaatggaggtactcttccgaggaacttacttgtgtcgtttctgggggatgcttcaaaggcataaagtggacactagaagcatgagggaggcctgcagacttttggagacatcgatgatgcaagtcttctcgacgcatggttggaccttctgtaatagattaactatgtgatgcttgtctattctcccaactgcgtttgggttttgtggccaa

SEQ ID NO: 13732 - DNA, 273 bp, Zea mays
gagaccccctgcaccactctccatgtaaatttcgctatctgacagtcaaagaagatgtgttgcatagtttcttgaacctagagactcttttggctcttttatcagaatgtcggtctgtaataatgtcttggttaaacaccctttcttgtcttagtcgtcttggtttggcaatagattttgggtcaggtctgatcaaaggtgtagctggattagatgctgagcttgtgttgccagtgacttgttttggctaagacatttctggtgtgtgtctgt

SEQ ID NO: 13733 - DNA, 1500 bp, Zea mays
gcagattgctttcatctcttcattgagtactctgtcttttcgaacagtccaagcatttctctctgccccacccattctttttgagatatgtctattaactcgttaagcgacattgtcctagtaccgaatgatttctgcactgcatccgagtgttttttttttgcctctcgatatcttgcttggtcttttgcttcagagaaaagggacacgcaccagcatttcttgaccctttcatcttgccgaacttgcttcctaaatcgcctgtggttcttacatcgtcatgctatagaataagatcctgattagtgagttacgatgataatatttgtaaatccatcatttatggttccagcatcaaattttgatgctgggagggacagttcgcgctgttgagttttgagcaatcatctaccttggtggcttggccccaggaatacaaccarctaacttttccgttttctgattactggatcttagtccctaagccgcttcagcggttcccctttgtgattggaaggccagctgttctctttcttgttctgcggatctgattctatggtctctaaattctcgcatttttgttctgtaggcgtgtgtgtgcaagtaagcaattacctaactttgtttaggctctattcgtttagtccggattggaggccggaaccattccaactcatcaagctaatataaatttgtgaactatttcaatccagaaccaatccagtaaagtattccggaagaaccgaacggacacttaggcgttgtacatttgtactcgcaaatatgagaaaagaaaaggagaaattggagttcttatttgtgcccaatcaccagtaactttattaacttgaatttgcattcatcatctatgcaattgtggaatccatttcaccttcttatgctagaactagtctatgcttcaagtaaatccttgaagagttctttatatccttcagcaagaaaattgcatacttccaggctccagcaagtaaaccgagtacttgatgggcccgtttgattgtctagtaattaaccttatcctgggctggcccatacatacagtgcgtggcattagcatctgatccttgggttcgtcgctaggtcttcagtttgcagcaccaactccaatcgatcttcactcttcacccagaacactctttattctgacctctggatgtgatccagctggtgcatggttgttagtagtactagtaccggcaattctgttccacgactggatttccgcttttgcccttgcgtttgcctacttcaccaggcttacttagccttttcactttggacaatctttatgtaaggctgcaagggttaagttgttccttgttgagccttgcaaggaattgaccgtgtccagctctccatctactccaccctttaaaagtaaagatggttcagttggcagacctggcaagttagaaggtcaccactagtcattcccaaaaatgatcgccacatcgcactgagtccaggtaccagagcagg

SEQ ID NO: 13734 - DNA, 133 bp, Zea mays
ctgcggcgacaagaagacgctgaagaagtggtttttcatcgacaagacagtaggctaaatccagtcccagagaacaaattgaagcaccactccccaccgcacagcagcacagctcttctcttcaccgatcccg

SEQ ID NO: 13735 - DNA, 371 bp, Zea mays
  unsure (1)..(371): unsure at all n locations
tgccacacccccccgttcggncnnnnnggcgcgatgcgctatccatccatggccacgatccgtccgtgccatgccgatcccgcctgcggctcagcagcgactccacgggggccacggccgcggggggggattcaccgcatcgcgatctccgatccgatccgatcccgcccgatcctcgcgccatcttttcttttttttttcttcttctatagtgtgtagatagtgtgcatataaatatacccacactgttcctccggtgattgcatcgttgccagcgccattcatccatttgtctttttgatttgttttgacctgagggcaaggcagggcagagcagagagcattcgtctcgatcacccagatctcgatca

SEQ ID NO: 13736 - DNA, 1500 bp, Zea mays
cgttcacacaaatatatgacaaatttaacccattgttttctttcaaaatattgataactcgacttattaaaaaactgtgaattgatatttattttgttgtgatttgttttatcacttttgattgtttgggcatgatttaaaattttatattttttaatagttttttattgagacgagtggataattttttgaaaaaaagagagtcaacaacatcatatatttgtaaacggggggagtacaagaagaatcagtaacatgggatcatggtgtgcatgaaaggaagtgtgagatcaggcattgacacagaaacacataatacaaatggcgtgagtacgtacttattgagtagggcggaggttgttggcgcgtggtagaatggtggggcagtgcatgcgtttctagaaggaacacagtgaagctttgttagaacacaagttttttccttctacatttgtttataaaataaactgatttatgtaaaatctttttgtctttcaaacagacactcaataaataaataaatgacaaattaagcttacaggaagagtatatatgtatatgtatatgaatctaattgtggtattgtgcgccgccattgtcttgtcactcatggttccttgaacataactttgtccgtaggatgaatcagagaacgaatacgagtcggtagaaaagaacacggttctacattaaacaaccttgcaatccaagctggtctcgttatatatacagcgttgatggtcccttgacagaagatcctgagtgagttctgaccatgcctttgagacttcaagtgggcaacgtttctctcctctcagcgcaaaaagatagatcctctgctctaccggcctaccacgttcgtctcccgcgccggccacccaccgctgccaccgagggtaaaaccgtcaacccgccttgccccggcgcctataagaagttccctctccatttcttcaaactttagttccagagccctccagagcaaaaaaaatatattatcgaatactaaagcattttcctcatcgatagaatatagaattttaaaaagggagcgaaataggttttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgttcttgcattgaacc

SEQ ID NO: 13737 - DNA, 94 bp, Zea mays
gctaaatcttgtaatcaatggtgggccaataatgaatttttttgcatatgtattaagacgcttggtctgatttcgaaattgtctagagtttttt

SEQ ID NO: 13738 - DNA, 171 bp, Zea mays
tgcctcattgtttgatcatcacaggctcttctgtggtcatatgcattagttgaggcacaggtcctaatctgaaggttatttgcagaaattcatttttctagatgatgaacatcttagtgtacttgtagaagttatttgacagagggagaagagaagaaacagctcattggg

SEQ ID NO: 13739 - DNA, 1500 bp, Zea mays
ccaacacaacacatgtctttatgttttatactctactcaataagcatatttgaaatccgtagcgacgtatgagcactttgctagtagtatatatattgcttctgctctacgagaaagccaactatttttttttctaataaaaaagagaaaaccaatataattatrcacaacagtgatttcgtgctccattgctgcattagcagctgagacattgaaaacgccttgacatcatgtaaagttgctagtcttgttgttaggctgtccgcaatagaacgtataaaatagtaaatttacaaggtagattatattgtttgctgagtaaagtttgagatagatgatgtggtaggatagatgatgaagatatactacagacacatctctgctccactgatgagcacctccatgagtgtgtgtcctgagggaaaaaacaccctgttgaatagtatagaatagattatcgtaggtgaaaaagraatgggcattgcattaggtaatcttacttaacatgtactacagatcaagtagacaactcctagattcgaagtagctgtgtgctctcttgcttctcctctctcactgctgctgctgtggtagttcaccatttcttacttcccatccatgtacagctaggcatgattgcacacgtagaaggagcaaagggttcctttcgcttttggcgctgcctcggtgatcgttacatacatatggttgcatttcgacgacccccctagctagctccttgtcttgttttggggaatctccatgatttcatggcagccttttttgcgcggacagcaggggggagcaaatgtttgtttccgagtttcaaattgacacatcatcatgtcgttaggatctctctctgttgctaggtacaaggccatgcatatgggcttcagtttccttctgttttgtcataaaatgaaacgctaagggggtgtttagttcgaggaattatgtattccatcttctctcacttcttgttttttttttgtttagtttctggaatagataaactcatgcatgatgtatcatctaatgtagaatgaattgattttttcaaaccaaacacatccctctaattaacacgcgctctaggtacgtagacatcttgaagatatagggcctgtttggcatggctccagagcaaaactctaaggaggagctggccagagcatgccaaacaccctaactccagagttgtaaactctatggagtttttggagctgcagtacaattttttggagtacctcttttgctgctctgaaaactccaaaaaagcaacctagtcatggagttttgagttatttacccgccattgccactggttatgagaaacaatctaaactctggagcagagctgctctacccagagttttagagtagagctgctctggggtggagcagagccataccaaacacaccctaagttgacgccgccgacactcggctccacttccactggtctacactccactcaccagctcccatccgtcgtcc

SEQ ID NO: 13740 - DNA, 158 bp, Zea mays
cttgtgtgttcgcaggagctcgctactaagccatactaacacttaaccaagttttgtggctattagtatttacaggatcacctattcacccccctctaggtgctctcaattggtatcggagtcgttctcttcacgtaagggactaatcgcccgaagag

SEQ ID NO: 13741 - DNA, 95 bp, Zea mays
cgtgagtattctcgctgctgttcttctgcagtctaatttagattcagcccttgttagcttgtgaattggtgttcaacctcacctgacttgttagg

SEQ ID NO: 13742 - DNA, 304 bp, Zea mays
tgtctcaagaagaagatcaatgatgctcgtgcaagcaattcatcatggccgtgctacatcaacgttaactacaatacgtacaatattaaatacagacgtctcaattaaccatatatacagcaatgtggcagaaatgatacatcagcctacattccagacgtctcactgccatgtaaatcagagtggcgctcttatatataaaaaggcagtattccccccatagtccattcaactccaccgcgaccatttaagcaacacagcagcggcatctcagctctgttcccagctagttagccgcggcgcc

SEQ ID NO: 13743 - DNA, 452 bp, Zea mays
ccagatcgatatgcgggactcaacggcagcacaacaccaccacgagatggaggcaaactggctacgacggcttaggacatgtgaggaggctgacagcaggggacttcgcgatggttagcgagacttgacggcgaatgacgacaaccggcgaggttgacgacgagccgatcaaactaaaactccacgacgccgaccggcacacgggttagagaacggcgaccggcgaaatctgagctggcaagcgcacggcagggagcttcacaatttgacgggaccgtggctgagcgaattttatggcgcggactgggaaaggactcggcaagcgacgacgcgaggagtaaagcgagatcgtggtcgggcgaactctatggcgcggactgcctcacggccacgacagctgtcgcgacacgcacgacgtcgccacaccacaatatcaccacgaccataaaccg

SEQ ID NO: 13744 - DNA, 127 bp, Zea mays
ccaagaacaaaattagcaaatcagctcaccagtacaaacctgactcgagtccgcaaaatcgacgatgagtcctagttaaggcattatgttaaacacacggtgagctccgcactaaagccttctccac

SEQ ID NO: 13745 - DNA, 278 bp, Zea mays
cccaactccctcgtcagtcgtcgccccgcgtcgcgtggtcctaatttaagccaccaactgccgatcaacggcgctcgcccgcccgcccgcccgccagcccgcgcacgccgctcgctccccactcactgccatgggcctggctcgccgcgcgacgctcccgtcgatccctgccgcgctcctctgatagtcacagctagccaggcggccccgcttgccgtgtgtcgggctcggcttgtcccacgcgcgggcgcggagcgggttgttggatcaagctgacc

SEQ ID NO: 13746 - DNA, 966 bp, Zea mays
cgtttatttggcccgttttgcgtgcatcatcagcccacgtagcatatccggcctaatttctctctctctctctatatatattttccctaaagtttcttgcaggaagaaattttaattaaaactgtaaatatatactcgtgtcatcaattaggtcggccgccaattagaattgcggtaaaaagtactccctcctccgccaaaaaaaaagtgttactaccgtaactgtggtcaaaaaattttatagacaatatcagtaatattcaaatagggcgtaaaccccgtttatatctctgttgtgaagcgaaatggtagttttgctcaaggtgtttaagctctgtaatttcagccctgcgatttaaaacgaacatgtagcaataggttctaataaatgtctgtacatcgagatatccatattatgaacattgtgtgacatgctagcaatgttaacgtctcaagcaacgaacatgtagctagtttcgctaacatatataaatgaaagacaagatatttggacaaagccatgttggtctactagctaccaggtcatgaaaacaagtcagcatcctactagttcatctttcccagcacatgaagacaaggcaaatttttttggataagaatgagagagtgttggagcaacaaaaatcattattttttaataatatctgttttggtgttagttgctctaagcacttggcgtcggttcaaattcaatcgggtagggagttttgtattttttaaatttgataaatatttatgaaaaataaaatatttatgcagctcgcgagatacacgagtcgtctgcatcggcccacccagccgcggccggcggcccacgccacgactcggcctcgtacggtcgggcccacgaccccgacccgagctgctctggcgccgtgacgccgtcttcctgttccccgttacttttcctcccccggcgaccgaagccgccgccccagccacgcc

SEQ ID NO: 13747 - DNA, 176 bp, Zea mays
cgcggagactcgtatataaaggcggcggcgtgtcgtccggtgctcctgtgagacctggtcacctggagggtgcaagggagggaggcggtcgaatccgtcatccgctgagcacagtggcggacccagctgctacgctcccgagtccgaggggaaggcagaggagacaagcaggcagg

SEQ ID NO: 13748 - DNA, 1500 bp, Zea mays
aggccgcactgttggaaagggctcagaatataatgttacatggtcacaagcgctaaacgatggaggggggagaataacagtccacccattagattgggaatttcaaattttatagaattgtaggtattcccattagaccctatgttgatagaatttatacctacagccagctcgtgttctgtaaattcaaccttgcttttggattttaacctctagtgtgtgtggtttagtttctgaaagcaaatggaatatatgtggtccaacaatactgccaaatgatatacagccatttaccgacggcctacctgtgtaattttcggtaggtcactgttgttaaattgttcaacttgtgccaagctgcggtgtagcagccaactaactgatctgactatctgaggaggcaaatagtagtagaacgctagcaatagtaaaaaaacagcagcaacattagcttagaatctgaagcgctaagcttatgtattacctctctgggaaagcctccaattactaatcattggagtgaggaatttggtgcaactatgcacctgataacctgtttccacacaataagccatactaatcattaatcgcccccctcagaaatctctaaaccctctctcaacctgcagacaccgctgatgttactgcctagtttgggaacgggtacgctccaacaacaactggtgacgatctcctgcagtctctgtgatcatccgcatctacccctctgctgacaattgtgtgctgaagatgtttgtttttaatcagcttagatagctcagcgcacagcgctcttggaaactggtgatctgaatatcctactggtactttcatttctttgtgataagattgttctcaacggtgtatcttttaagatacacccccattggggtttttttcccttttgcaatataccaaatctcattttggatttccaaccagttgctatgtgcgtgcttagagtaaaaatctgctcttctgaactctgacggttcaatgtcgaaggaggagctgtaacggttggattaagcggggcgacggctcacatttcagaagccttcacatgatggcattgacacacctcaatccaacagtcgtgccactgccaagctccatcgcgccacgcgtgatgtacgtgattatgatctcactgactagcgggcccgcgtacagattcaaccctcccctcccctcaacggctagttccacctccgcatccgttgggacaaaagggggaaaaaccagagggaacttcaccagccaccaaagtaccacacctctcctctctcaagaaccaccgcactctctctagcaggcctctgttttgtactgtaagcaggcctctgtagagtttgcaaaatgaaatttgaaatagaaaataaatactgtatattatattgtttgtaaagtgaagtttgaaacaggagcgaaaaggtagatagtcactcagcttctcgagagatcgccaaagacgcggcgccggcagcaagttctgcggcg

SEQ ID NO: 13749 - DNA, 160 bp, Zea mays
cctgcaaaaataacaaaaaaattgtaaataaaaaactgaatataaataaacaatttccaagaactaaatatactaagaaaatacattttataactccacacaactatacttagctagcttagattatttacctaaacaataaacacaaaacaaattatca

SEQ ID NO: 13750 - DNA, 1192 bp, Zea mays
tgcaattgcaaactatgatatttcaaaactatagtattttaaaacaacattaacatcgtatttccttagtctcgagacaataccctggtatttgagcataccgcagtattttaaacttgaaggcgtttgtgaacatatctaaaaactctggattttaaaccatggttttaccataccatggtatttttgggtcaaaggatcaaagttttttgtttgcacacaattgtggtcttgtcttctacattacaaccgaaatactgtctccagtgctagattggactgatgtaaaatatacaacataggtatgccatggcatataatgaattgtgatattataaactgtggttttgagaaacagagttcccaacacaggtccaggtcctaagcttagacagaaaagttagataggttatgacgtcttaggcagcaaaccaaacgacccttagtgataggagacttatctatcttaactcttttgacacgggcggattggatcgtttatcctatgaaattgatttagttaaatataaagtcatcacaactaataaaaagttagacaggtgctggattttatgctacgtcgagactaagctcaatagtcttgagcaaaaatgtgttggtaaatttagcgaagccaaaccatacacttgtcttctaaaaaagcccacacatctttctatcagaagttcatccgttcgatttgcagttaacggctcagatgaaaaaaattcccaaacccacgagcatctcagtcccccaaaccgtaaatcctataaattccattccacatataccccttcgatccacggggctatggcaattgcctctcaagctcaagggctcaaggccattagcgtaattacaaaattgtaattaattctcaatctcaaggttagtaacgtaattctagagcttccgagcagaaaaggtacggagtcggaaggatatgatcgcttaggagtgcggctagggttttttcttgtcacaccttccctcggtcccttccatcttctagccgccgccgccgccgccgctgcccaaaaccctacctaccctcttcttccccctcactctcctttcatctccattctaatggcggcccaacccgtccggcgaagctgctagtgcttgtatctactatcttcatcaggtacttcgccatcctactgaagtattccccgccgccgctgcc

SEQ ID NO: 13751 - DNA, 272 bp, Zea mays
agtaagcatgatgcgaccatactgaaggttttcagggtgaccatatgcctatgtcattattgatttgtttgagtgcatatggtgatgagattgtttcactgacacgtgtatcccagggccacttgcgagccagcgtgtcagtgagatatgggagtcacatgtgcagaaactcaacctaggggagctgtatatcctaagtactttctcttgatcaggttcaggctgttcttttggtacttggagggtacgaggttccgcctggtttggtaaac

SEQ ID NO: 13752 - DNA, 164 bp, Zea mays
tcgtaggcccagctacagcccatttagcccatctcgcgactacagtgtacagccgcaaatcgggagaaggggtttttatgtctcctcgcccgctccgaatcagctcgaggtagcagctccccccgcaaaaaccctagctttacctccccacaagcgcctccaag

SEQ ID NO: 13753 - DNA, 235 bp, Zea mays
agcagagcaggttccccctcccctgtgatgagtggttgctgcattgttattggccttggtagttgccatgttgctgttgctgaagcctgttatcatgtattgatgtgtggctcaggcagggtaaggccataaattgaacctgaaattggactgtgatctcttttgctgtggacgggttaccattaaggccctgtttggaaaccacggtttttaatactataatatactttagtca

SEQ ID NO: 13754 - DNA, 1497 bp, Zea mays
tggtgaagaaccagccacaggtgaaccctctgctggctggcctctcgtgctcatcttcatagctagaccgtgctttgccgagcgggagaaggagaggatgtggatggttttggcctcaaaatgttgatggctatttatattgctgccgatgcccatggttgcagcgaggtttgagggatcgagagcaggtaggggatggagtgaagtgggtggtcaacactatcatgctctagttgcttgtaattctgcacctttatattgcataacaaagtccatctcatgattctaaaagggttcagggttttaaattcttctcgtagtgtggattggatgagaaatggtgtttttatgctggcatacagatatgcctatgttagtttttcactgctatgcagaaatccgacaaggggaaagaaaaaaaacccgacaggatttcgtcgtgtgtcgtccattcagaagaaaatatgctatattatcacataacgactcaagcccagcagtttcagggatggaacatgtcaatgtttgacactcagcatttgtggcagggggcacaaaaaaatttagtagagatgtttgttacttactagagatcaaggaagctaaccgcttcatatttcagatttcaccctgtcaaaaggtctgcatgaaatggtgtgtgtgtggcctcaactgctctgctaaaaaaagagcccactgaccgcacagggcgccgctcttggtcagctagaatggtctagggtaatagattcgtcctgctccatctccatgcaatgcaagagagtaggttaaactaacaaatgatcgttcgtttacttgcccgtttgtttcatttgctcgcacttaattaacctgtgcttgtccatcctgcggtctcttttcgaggtgggtagctctgtcttttgtttggtgccaaaaagaaatggggtgcatgattgcatctggtttggtcggtgggagccagttcaggcgaacagattgggcccaatctacccgatgcattgaaccgggcccatgacttctatctaaaaggagagggcactgaacgcggaaacagtcggagagcatgaaggagaacgactatgaacaggataaaatggaaccagcaaaagcaatgaatgaactattgcgcatctccctgcttcagtttgatctctagaatggaaacactagaccattaaggtgccatcattttcacctcgtgtcagctcatccaccctagctaccatttacaagcaagcttgccggttcaatttcctacccatcccatttaaacatggcttttggttaatactgctactcggtatccatcttctgaacctgaaccccaaaatggcagcaagtgaaggtaccgtcatcatggagaaaaccccgtgcatgcgtggcactcttcacaagccatcaccctacccttcagaagaaaccctagctttccttccagctacaaattgagaacttaaaacatatgacaagtaacaacttactggtaacaactcc

SEQ ID NO: 13755 - DNA, 1168 bp, Zea mays
agaacaaggcaacatatagaatgttaaacgataaagtccttcgtcctttgaggcattatttcccttaggatataacggtctccggacgaaggtcatgaaggacgaaccttcatcattacagtatacattaatgaaagacgaagcatatgaaacataaaagatagcacgaataatcatataacatcattcatttaactttattatatcatcatagagaaatagagacaatatcgaattataaatgtaccttcggcttggaaggagatgaaaatacaagtgtgacgcaaaagcaaatgccaagtcaacgtgaacagtacgggggtactgttcacctatttataggcacggggtacaacccatacaaaattacatacatgccctttacatttggtgataattctatagcactctatcgaggtctaaatggccttttcatctttaagtcggttcccttttctgcgaacatgccgaagctttcctgcttcacagcttcggcgctgtgtcaacctttgtagcttttccctttctgatacgagtccgaagatacctgctcacacattttaagccgcttctcccttgaagaccttcggcgacgaagcatagacccaacagtagcccctttcgcggtgctagatcgtttttcgtaacgagcttgatccgtgaaaaaagtctcttaagcttcggggagccgaaggtccaaaaaacaccttccctgagctcgttgccgagaaacgatttaatttcccagcacgcagcggtcccaccttgcagagtttactgtttgtccctgcggtccaccgcgcagcgagcgcaagcgggtgtgcgcctggtgtaaaaactctggcgcttcgccttcttacctgcagcactatataaacagacgagtaggtgtgaagttaccacagcattcattgctatttgcactgttttcctgccaaaatttttaaccatcgccgaagcttgtctgttagaaacgaacgaagctccagtttgaaacctgcttcggaggaagaaaattttaaagtttcacaagttcataattgaatggccagagtccgctctaccgccagggttgagcgcgagggggaggaaactgaagcttcggagactcttcccatctccgaagccatgcaacgatcgggtctagtgacttcagaaaagatccctc

SEQ ID NO: 13756 - DNA, 190 bp, Zea mays
gtgatgtgaggttccctgcctgcctaaaatctagctcgatgacgaaggaataggataggttggtgtagtttgctcaccgcttcgcaaagagaatcggcgtgaagctctctatctctctctctcggctgcagtgcagacctgtacttgtttcctatctttcttttcggacatcaagtaaccctgaatctga

SEQ ID NO: 13757 - DNA, 1500 bp, Zea mays
aagtggtggcaaagtatgatccaaatatgcaaaattagagtcaaaaacaatttggttctcttttgcattgatattgcacttcttttggttgcttttggatgtgttggcataaatcaccaaaaagggggagattgaaagggaaatgtgcccttgggccatttctaaagtgttttggtgattaagttcccaacacatattctctaagtgttaaattgtaccaaagattgaagaggtgcaaatcatgtaacaaggtatgtttctagactaacatattgtatctaagtgctagaaacaggagaaaattgtttggataagagttggttgtgtacagccaactgctgttcggtctgggtgcaccggactgtccggtggtgcaccggacagtgtctggtgcgccaggaccagtcccggtgaacaggctgctctcgggactcgacggcggcgtacgactacaattcaccggactgtccggtggtgcaccagactgtccggtgagtcatccgcggcgaagtcgtcgctctcgggaaaagttcaatggcgtacggctaaaattcaccggactgtccgatggggcaccagactgtccggtgagccaacggtcgactgcgccaacggtcggccgcacaatctttcgtgcgacgcgtgggcacgccgacggtcggcagggggcaccggactgtctagtgtgcaccggatagtgtctggtgcgccaactgccatgaatctgcaacggtcggatgcactagaaaaggaaggagatcgcgcaccggacagctacaatgactgtccggtgcgccacccgacagaaggcaagattagccttccaagaatgcctccaacggctcctagctgccttggggctataaaagggacccctaggcacatggaggagtcacccaagcatactttaagcattctaagtcttccacaatccgtctctgcgcacttgattgaccgtattagtgatttgagctccgttcttgtagtgaactcgttgtgcttcatttgagctcaagtcttggcttgcgtgcgtgtgtattgctgcggatttgtgtgtgttgcttcccatccttactcttgtgctttcaccatgatctttgttgtaagggcgagagactccaacttgtggagattcctcgcaaacgggaaaagagataagcaaagaagtatcgtggtattcaagttgatcataggatcacttgaaaggggttgagtgcaaccctcgtccattaggatgccacaatgtggaggtaggcaagtgttatacttggccaaaccatgggataaaccactgagtctcttgtgattgtttctctgtgacacttgtgtgttcgcaagagctcgctctttagccacttggttttatcgtactaacacttaaccaagttttgtggctattagtatttgaattttacaggatcacctattcacccccctctaggtgctctcaattgatatcagagccgttctcttcacgaaagggactaatcgcccaaagag

SEQ ID NO: 13758 - DNA, 216 bp, Zea mays
tgtgcaccagatatgttgtctttaaaaaaagccgtatcttagggccaacagatcgtgtacatattgggagtaagctgctggaggtagcgagaacggacagcagaagcgtgcggcattctacaaggtttttctttctaaaaacatacaatgcctccaactattcgtgtagtacatttatttttgttcaattaagtaagcgcgtgtaatccacacacc

SEQ ID NO: 13759 - DNA, 1500 bp, Zea mays
cctatccactactagcagcaagtctgcctccgcaacgcacgcgtcacttctctatagttcgtagcccaaagtaaaagtcatttagatatttatttaatttagtctataaatccataaataaaataatttaactatgcccaacagagatgatagaagtgataatggatcgtaacacaaatgtttattcacaattggttactatcctaatttaattttagttaaaaaataaataaaaatttaattcgtttctaatttagtttgaattttaaataatttagagctatgtcctgccagacgcgatggcctagagccgacggcatgcacgcaaaacctgcggcgaggacggtagaaaaaacaggggaatcaaaatcaacgcctcaacggtccctctccgtgcggtgttggactgtaaaattgaaaagcaggcgaggagggggagggagggtagggcagggaggacggcgaaaagggccgccaccgtcctgtgcgatcctgccaagaggacacgacctggagatcgtggggggaggtggtggaggtcgccctcgctcatccaaccgccagtgcttgcttctagaccaacccctctctctcggcttctccgcctcaagcctcttcccaattccgctagctgctgcccatcggccgccgcgaaccgaccgaccggtgctgctccggctccgccatggccggcgccggcgccgagctgggccgccgagccgctgcgaacgctgccaacaccgcgggggcccgcatctaggctcggtagattccgctcctgctcttgttcccagcttgcttccgtgtcgctgtcgcttcagcatgacaggtttgccgcggggattgcgatttttagcttggtgccacagtgatggctggtgaggcgcggcgcgggtaaacttacgagcagtagggagactgtcctgtcatgtgatcctgctctcccgcccgtcgcctgtgccctgccgtgccgtcggtgggatcgtaaaaaaaaaatatggctctcaccgcgtcctcgggaagcaggaaggtcaacattgccatgagtggctacgctggtagattcgggctccttgtcttccccggcctaatcagtgtgatcccgatgtaggggagtagacgacactccaaccaccatcctaatcagccctctagcggcgccggggccccgcgacgaacgccgcccgtccgcccgcccgcctgcctcttccgccacctactagagcaaccactcacttgcccgacagcgtagctagctagctccgctccacgtccagatcactcgagtaggccgggcgggggtgcttcaattccgctcccagttccgttcgttggttttgcttgtttttcgatgtgggtgcgcttttctgctgcttataatactgtgatcttggcagatggcgtagagggggcagggaacagcgtagaggagggggagtaagaaaggagaggacacacacatacacagagagcgagagagcgagcgagagagagagatag

SEQ ID NO: 13760 - DNA, 1500 bp, Zea mays
acaaactcccaccactctggaagcttcgtattcaccgccggaaaagaaaaaaaaggaaaaaaataaagaagggaaaccttttgccgtgcggtggtggtggtggtgctcggtcctctctctttcgagatgcaccggacgttcagagaggtgagcctaaggtaaagtcgccacggacggacggacggccggccgatgcttttttttttagtccaccaccaccaccaccaccacgacctccgcaattagatagtggcgcactacacgtctacgctcagcaccacgtacggcagggcagatcattatcacatccagtccagaccctcgcaccaccccaggcagcagcggaatcgcgcgcctttcgtcccgcacgcaactctgctcgctcgcggaactacctaccgtgcgggtgcagcggaacgcaactgcggattcccatctcctctttacagtcacaagggctctggactctggagtgagtttggtttgctaccgccgcccatggccaacgccacgacaaatcaaaatctgtcgacgataaaaacaaaaaaacaaattgtcactcgactcgagtggtcggattggtcagccgcctgcataaatttacttggtatttagttggctgaccgtgcaggttttgctccattcggttggcacactgtattcttctcgaaaacgggcctagttagcaacagttgccgatcctcagacaaaaaagcatactggccaatacgaagggggtcagctactagtattatcatgcttattagggcccaacctcaacgggccacgagacccagtccgagcaacacacggcgcatccaacctcatgtttgcgctggcactgactgttttgtgggctgccaagcgctcacaattaaacagtctcactggatggacaagtaatgaaattacaaagctttacaacactaaattataaaacgttttgatttttctacgtacattattttttactatatatttagatacaatgtatatttaaatacataacaaaaagctataaatctagaaaatattttataatttaggaccgagggagcagcaaagaccaaagaatgcaataggatagtataacgaatatgcccttaaagaggcatatacacatggaggcattgtgctgcacgaagtggaaagcggaaagaagttgaaatgggatatgaggattgaacaccagctttcagatggttccttgctttgattacttgtgacatgtttggtttaaggattaagatagtctatcatcttctcacctctcactttcttttttagtttgttgaatataataaattgattcatcagcatttcattcatcataagctcataattagtaataatatggagaacgaatttattccaccaaatttataaaataaacttatgatacacaacatcatctaaaatagattgactcttcaaaccaaatgccccttagtttttctgtcttcacgtgagaactctctcagcaagtatctatggtatcac

SEQ ID NO: 13761 - DNA, 1500 bp, Zea mays
gacgcggattcgttgctcatttcaccggacggcgaaggaggaggggcacatgtatgcatgcgtacaagctggctagccatgtgcgcgtgctacctagctagctgcacatcatgcatgcattattcatgccgcctaacagtatatatatatatatatatatatatatatatatatatatatatatatatatatatataacagcaacaaatcatattaattaagcatgcatgtagcaatatatatatggcaatagcaatggatgtcatgtgaatcatgtgatgggatggaaggtgatgggtgaggtggttagcgtgccccatctatcggccggacgcatcaactcacatgaccgcacgtacgcctagctatagctagctaataaccattccatcatccaaaaggaccacgccctccaacatgtctccttgtctgccttaactacgccctcccctgcatgtctccttcaggtcgttctcagcatgcactctggtagtaaacaaaaaaaaaaaatggtttaccgtacctaacgatcgacatgttaattaatagcatcgaggatggttgccaatgattratttgcctctgggcgctggctcgtcgccacactgctgctgcagcaacggtgtggagcagagatccgtcgtcgtcgcgctacgccaccgacagaagctgcagggacgcgcacctgggctagctgtcagcctcgcccaccagttcattctgcaaacctcctgcccaacaccagtacgtacgtacgtactgcatgcccccctcaacgacccatcttctgcgctgcgcattagtattcttttctcccagcagcatgcatgcacatgccgtacgtgtagtgctttgggttcttgcatttgcctcaactcgcccggctgctaaattctcacacaaggctgggcgagctcttggctctgatctgctgttacagccttacatgacagtgacgcaacgcaaaccagtggggcaaaaaaaaaaaaaggaacatgaatgcgcacagctagcggctaccatgggctacactacatgcgcagctagcatagcatagcatatatagggcaggctcgtgcatgtgtccaccacacacaccatgtgtagctagctgggccatgcgtcgtctcctccccattacaacaaggtcgagatggaaagcacccgtacytgctgctgcagcacatacccgttttaaaagggaatccaacaagagcgcgtgtggctcgtcgatgctgctgagagcgagcactcagttcatcacacccatttcagaccttgcgttccatatatatgtatgcttagtaggtgatcatcgataggttgccgaggccagctagctcttgcgttgattaggaaggaaaacgtagctagccagccaggttgatatttagagttgagagggtacagaaatacatacagaggccagtccagaccatagcgctagctggctgagacggccgagaggaacgaagacgatctcgatcctgagctctgggc

SEQ ID NO: 13762 - DNA, 110 bp, Zea mays
ctgcagattatatcgtcatcatccatcgtcctctataaataggcaatcacatctccagtgcagacagatagatagagtagtagtaggcttttagctgaggggaggcatcg

SEQ ID NO: 13763 - DNA, 1279 bp, Zea mays
actaaaagggaaatgtgcccttgggccatttctaagtattttggtggtttagtgtccaacacaagtgctaaaatgtaaaatggtggataaagtacaaaccaaggataaaggtatgtttctcagacttagtacattgttttgtggactaatgtattgtgtctaagtgctggaaacaggaaaaatccaattggaattgtcttggctcgagcagccaagactctgctcagtctgggagcaccggactatccggtggtgcggtgcaccaggctggctcgagcgaagtggtcgctctcgggaattcaccggcgacgttcggctataattcaccggactgtccggtgtgcaccggactgtccggtgagccaacggtcggcagggccaacggtcggccgcgcaatctgcgcgggacacgtggccaagccaacggctagaagggggcaccggactgtccggtgtgcaccggacatgtccggtgcgccaacggctctcaggctgccaatggtcgactgcgccatttttggaaagaaattgggcaccgcacagtgtccggtgtgcaccggactgtccgatgcgccagtcgacagaaggcaagatcagcctttctagaatgctctcaacggctcctagctgccttggggctataaaaggggcccctaggcgcatggaggaggacaccaagcattcctacaacattcctaagcaccaagacctcgattccgcgcatttgtttcattgtgatagcatatagagctctagtggagttgtgaactcattgggttgtgttgcgagctcttgttgcgacttgtgtgcgtgttgacactttgattcttgtgtcttgtgtgcgttgctaatccccccttgctctgtgcttctttgtgaattcaagtgtaagggcgagaggctccaagctgtggagattcctcgcaaacgggattaagaaaagcaagcaaaacaccgtggtattcaagtgggtctttggaccgcttgagaggggttgattgcaaccctcgtccgttgggacgccacaacgtggagtaggcaagcgttggtcttggtcgaaccacgggataaccaccgtgccatctctgtgattgatcttttgtggttattgtgttttgactcctctctagccacttggcaattattgtgctaacgattaaccaagttttgtggcttaagttttcaagtttcacaggatcacctattcacccccccctctaggtgctctcaattggtatcggagccgttctcttcacaaacggactaaccgcccgaagag

SEQ ID NO: 13764 - DNA, 274 bp, Zea mays
agctgccctgctgtattttttggagttgtggtgatgtagcttatggtacggcatttccagcgaccgagaactggtagtggcattagcagcttctatgttacctagagagtttattgtcaaactggggaaaaaaaactgaaggttagatcggtgtagatctttctggtactgtattgtgtatccggcaataggcatggtattgtttttttttttgctgtgaatccactggtaccatgtttaaacttatgaattgttcaaaatagaaaggtgcttc

SEQ ID NO: 13765 - DNA, 249 bp, Zea mays
cctgaggggttgggggcgtccgatcgttttgctgtggatttattgggaacttgcgtgactcctggggagaggatgtcttcgctcgagcgccgagaatcttccgcgcgaatgctgaaggttaccgggggtcgctggcctaggaatgttccgattccctaggcggccagcgaggacatttgtacgtctcgattagctcatgagatgaagattttttcttaccggtggaatgttgctgttgttgtatcggca

SEQ ID NO: 13766 - DNA, 1446 bp, Zea mays
ggaccgactaatgaagatgtgcaatggtacagtagcctgattaggatcagggaacttcgccgctgatgaccgtcgcacagtgattcacgtcgatcgccgggattcgtgcgctgtgacttgtggataacggcaagcgagtaaagatcttggcgcctggatccacttgagcccggccacggctaagctcaccgtactccttgctcatcgaccgatcgagataagacttagagtttaccgccgtgcgccacgtgctaacgcactttaccacatcaccgtagcttggcttgcgatgataactcatcgccggtgagttcgccacgacggaagacacgaatccactgcgccagtaactttctattttctccggtcgccgcgcgtcttcttccaattcatcggccaccgctcgcgggctctataaattaagcacgtcctcagctccgtcgtgtaatcaagcagctagcgcacccacccgcacctcaaatcctccaccagagagctccaattttgcatttcccccaaatcaattccgaacaccgcgcgtttgggcctcgccatgatcagcccaatccaggttcgttcatgccctctgttcgcttgttttagtactctaatatgctcctagtactctctgacccggccaattaagctaggatccattggatcaccgggaacacgcttgttcacttgttgcctgcactgtccccgtggactagatgacttagagtttcgttagtgaaattgattgaggggaaatagtcgtataaggttgaattcggtatccagcaatgggaagggctagccgttgcgtaatttggccgtgttgggcttatgcttcgtcgccgaaggtctcataggaagaagcggtcttcagctgaagctgtttgtataagatggccgaaagttcctcttcgtgaagcttcggcattacaaaccgacttaaagatagaatgaccttttagtccataaaggtctgagtcaatgttgtaagcttttataaggggcatacttgtaattcctcacaggctgcgtcctgtgcctataaatagtgaacagtattcctttactgttcacgcattctaggaattgcaatcgcatattttggaattcaacctttgccaaggcgaaggtattattgtattcaatgactcaatatattaagtagatacaatgtaattcgtctatgatgtatttatcccttttataccttttgttttatgttatcttataatttttactgaaattttattacgaagatttaagcttcgtaattatgctcttatcagccttcgtccaaggcccattatcctcaagggaataatgtttcatggacgaaggacattgacatttaacactttatgttgccttgttcttaattcatagcatttgagaacaagtccccaacattggcgcccacctccggtgaactcacttccactttttgagctg

SEQ ID NO: 13767 - DNA, 1500 bp, Zea mays
agagatgaatgtgaccgtcatattctagccattcccttcgagaaaacaaggcgtgtgaagtgtgatgctgcctttttttatctgcctgatagaatcatgcaacccccgcgtcagtcatgtggatgtggtttactactgcttcacgaatcggcgatgcgagaagttcacggaaggtgcgtgtcctgtttgggtttttgtagtttggtcgggagattacgagaataaagccattctcctccgtatttgttaggtagaacgaagtcattctaattttttgtttagtttaaagatacaatagaacgaagttatttcgttctttatttagttagaaagccatggacaagagagcgaacaaaacgctcgtgtccgatcatattgatgaaacaaagacatctaagtatataatagaaatagaaacttagaagccgctcgactctattttattataaaccaaacatttagaaaataaaaatagagttctatttttctccactcttcgtcaccaaacgcaccgtaatttattctgattagacacctctcgataaacacgatatgggactatccaacaaacgattacaataatagttttgtcgaaaatcaaaatattcaaaaatctgatcaaatttatgaaaaagagtgccaaatactataaaaatatatttcagtgaatctaataaatataaacacagttagttttttctaataagtttgatcaatttttttgctcgccagcgacaaccctcccttcatcgaacgtctggtccgaatattcttcttcgttctcgcgtttatctgtgcagccctgcctttcttctcccgttccccgcggcctgcgcgcgcgttctctccctcacctccgcccctctctccctctctctcgctccgggcgacggctgggcgaccgccgctttatccgtgcggcccttccttttgttctcccgtcacccaaaccccccttcgagctctatctgtctcttcctctcgaggcgacgcctgggctaccgcgccgctactgcggcctcccgcgacaggtgcctagtctccatcaggtgccatgtcttcttcgggctcttcaccggcgacgtgcactgccaggtacgctcctcccccttccccctccacccctcctcttcaattttctgtgsgaaaccgagcagccaaaccctaaactacgctatttgtattcggatctggtctaattacgcgtgcttacatgtattatgtctactaacctcgattgtttttgaattatcagctctgcatgtatacacccaagtcctttactgggtccgccgccgcccctacgtacttcgttaggtttagtatgttattaagtttgtaattctagggtctggagggaagcatagatctcaagaggggtgaaatttggtggtaatttcctgagaatttcaaggagacaagggcgtggaggttgtttctggagggatctgtgagcacagcagcagaaatttgaggttggtggtagcctgttgatccacg

SEQ ID NO: 13768 - DNA, 346 bp, Zea mays
tgcagtttgtagacggccggcaccacgtgtcccgcctcccatcgtcctaccgaccgtcagatacgaggtggaacatagggacgcttctagccggcgccgggggacacgtacgtgtgcacgtgtaagctcgctagaagctcgtggagcacaccccgtccgcccgctcgcctgctttttaccggcgcctattcacacacagcgccgccaccgcccactcgccattctcagtctcaccttcgcttccgtcgccatcgctcgtccgaattcgtcctcgcttgcacgagcaaagcaagcaacttgttcgatcgtccgcaaaactcgatccagccgctgaccgcgcgccgac

SEQ ID NO: 13769 - DNA, 1500 bp, Zea mays
cttgacgattagccgaggacgaatgaatctgagaaaaaaagtcatggtatccattccctccgtgcgccatggattagattgagtggggtggtgggggagacatgggaatgaagaaggcgaaggaagtaccacgtcgatcttctggacgacggtcgcaaaaagacgatgcggcggtggatccgccttaccggaggagctagtgggagtgtgaccggaccgagaacttggcggagattcgaaggagtcgcggctgatgaaaccgtagggagacaatgcgaccacagatcctgcttgacgaagtggacgcgctcacggatctggcttgccgatggacgacgctatttgcaaagtgtagtttaaaataaaaagtaaaatagggatgagatatgtattcagttggagatagcctaagatcatgtttcttgcgggtgagctcaccttcattgttgaaatattgtttttggctttcatttcataaagcggtttacaagtgagactaaaactgttttttaaatgtttgttaaaacatcttttcatgcatcgaaatcctatttgattctcatgaaccgagagaaatttgaaaatgatctgataattaaataaaaagcatttttaatattaatttcaattcatgaaattcatatgaccacgagggaaaagagmgctagtgtttctgccacaacaaacgtcgaacaatgtatagtgtttctgccacaacaaacgttgaacaatgtacaatgctaggcatacttgcagatttcgtgcctacaagctacatcccgcaacttaaagtttagatatgttacatcaaatatttgaatgataattatcgatattaaatatagtttaattataaaattaattgcaaagatgaagtctaaaagataagacgaatttattaaacatattaagtctatatttaatattgttaattgatattcaaatatttaatatgacacaaactaaacattagtcggaggaacacgggaccaggactccaggaggggagaacacgggaccaggactccaggagcagggtttacaatttcgtttggcatcattcaaatttcgttttgttgaccaaaatttgacttttgtatttttatattttgaatcaaaagcaatctaaattcggactgaaatttgttttttagttagcagcgaaaacaggaaaagtaccaaaatgcggtgatacacgctgtccgggagacgaccctcgttgccgatccctggtcaagtcgcctcctatttccaagtcctttctcactaggccatcatccacgcgctccacgcctccaccccttcgccctgcgccyctgcctataaagaaacctttgcgcgccccggcacatctcaccacaccagctcgactactagacccttgaggccttgaccagccacttccaaactttagcatcactatatctcaacgccatcaagctgtctgtcatcagtcatcacggcacagcagcttctactggccttagctcgatcgttcca

SEQ ID NO: 13770 - DNA, 169 bp, Zea mays
ggcgtggcggcgtgatccttgatgaggacattgccgaaatccaggacctgcaaccgagtatccacgtcgcccgcgtgccagacgccggccacatgattccgtgggacgacctcgacggtttcttcgtcgccctcggcgacttcctcacacaataagaacggagaccccc

SEQ ID NO: 13771 - DNA, 931 bp, Zea mays
atccagttcgttcgtacgacgtgctccagctagcccgcactaacaactacaagtcgtcaactgatggttggattagcattagctagaggtgtggtacacggccaaataaacactgttcatttgaaagggctatctagctaggagggagtccgagctggtggttgaccgcaacgttgcattaaactgttgatcctgttatgatttatatgagtttggtcaaaattgttagagagatctggcttaaaacaaatgcaaaatgccataatttaaggatgaatataatacacaaaaaaaaaacaatccactatgtatatgagcgcgcgcttgcatttggctgctgttatttagaatattctaaacttaggtttagaccttagttttttaaaccataatattttaaactgtagtattgtcttgattaaattataatgtaatatttcaaaaactatggttttccaaaacgttgttcacgaacagggccttatgcatatatgcatgcatgctatccggggacggggatgttgaaagttgacaagcaatggtatatactgcagctagcaatcatactgaatacaatgaatcaatatcgttaattacgtatttgtttttatttgttaatgctgaatggtgcgtgcttgtctcttctaactatcatccgaacgacatccatgcatctgtagtactatatgtaaatttaaaatgattatattgaaccatgcatgcttgtagaattcatgttggttcattatatatctccaacggttttgtgcttatgtccgacggctttgatcctaggactagaacatttcgagcttttttggtttactgcataacttgtcacactttgcctaacttttctaactaaggttagttcttcaattcggacgactaaccttaggcaaagtgtgacacagttagccgtgaaccaaac

SEQ ID NO: 13772 - DNA, 127 bp, Zea mays
ggtatttgtccagttattacaacagactaattgatagccgttttggttattttgaaccatcgaaacctaatggttttgcctttttattttcttattattgttcagttcatcttctcgactgctttag

SEQ ID NO: 13773 - DNA, 121 bp, Zea mays
tcgtaacagcatacacagggcagacaaagctgcgatttgggggggctgttgtccagccgtggtgtgggtggagataaaccacgtgaaggctggtgctctggtacatgttcgccaggcactg

SEQ ID NO: 13774 - DNA, 1500 bp, Zea mays
cgattcatctacagtttactcctcacatcttgatatacagttcaatgatttcacttcacacaatggcagttgatagacacgcagagcgtgcatcctgtccagaatatatgctgttctaatgtgtaccaaaatgccaatggaacatgggaaagaatattgatgcgtgtagctagcgagatctgggggagctgattcccacaaagctctgctgcccatatatatgcagctaaacaaccttatcatcacacgaactaccccaccatcaaggaagctatatctaattaaacagaattatttacgtgttgtaataataacacaaatattaagttttaagcacgtacctactcacatgcatgataaatacagcttgtgcgttcataagtcacaacttataggccctgtttggatgctgtgttttttgacaaactatggcgtcaaaagagaagaaactttattagttttagaacaatagattgtacaaatcatgatttagaaaaaagaggcctatagtggagtttctaaaaatycaaaagactacggtattttttctaatacgacaatgccaacatacatcgatacatgtcatatcctatcattttgttgtttctaaatatttttgttctatttttttcataaacggttataatctcctcattttcacaatttcaatgacatagctcattgtatttaacttattgatattagtgaactaagtactccctccgttcataaatatatgacaccgctgactttaaaaaattttgaccacttgtcttattcaaaaaataatgagttatcatttattttttcatgatttgtttttatcaattaagttagtttgtgcttgacttaaaattttatatttttaaataagacgagtggtcaaagttttatcacttaaggtagtttgtgtttgacttaaaaattatttgtagctactgtgccataagacatccaccgccattcaattactgaaaactaactaacagccaaataaagagagatctgatgacaaaagtgacacacttgcaagctactagcggcaagtcccagcggctagcagcttgttgtcacaccaacattgcccattggttgctgtagcctgtggcttggtctttccaacctcttgcacactagatcagctgcactgtcctcccacaagacaactcaccagacacctttcctcctcccccctgaccccggcccattcaggttattatcctctctctctctcttctttcttggtatccttctgttttgttttcctccacaaacctctttcaattcaaccatagacgacgacgaagacagcgccgagaaggtcagaggaaattgggctacacgccctccctaatccttccatatatagggcacaggagacatcatcttgctcatccatatcgcttgctggctttgctttcttccttcctccctctagatctcgccttcacaacaacgacgaacagcgggtacgtacttggagatccaagaagctaagaa

SEQ ID NO: 13775 - DNA, 687 bp, Zea mays
ggcgggagtacaaacacggcggagaccggagagaagggagcgatcaagaggcggagagatacctgggacccgggaagacggcgcgcggagtcgaggcgggacccacggagaagtggcggaggagagccccgcggagggaggccgaggatcggaggcttcgccgtcgtcatggcctccgacccgatggatccaggtgtggggggactagcctagggttttgggagcgagaaatggggatgctgcgggtgtgggggttgtgcggtaccggtgcggagtgcggaccatccatgaagacgacaacgatgcgtaaaagtgctcaatactaattgggcctactcaattggctttatgggcctaaagtcgatatcgatggcgggtcggcccaagcgattccctgttggattattacgaatcgaaaccattcttctcttctcccagctctcgctcgcacacgcacacccaaatcccaaccggctccgcaccgccacatctccttcgccggaaccctaaacgcctagccgccgcagccgcagccgcagccgccgccgccgaagcagctgcaggtgggatcaaggtgtcctacttctcacccttctatgcgaatcgaaggtttctgtattcgcccgccttaatccaagcccgaaacctctcagatttcctcctgcggtgacgtcccggcaagccggt

SEQ ID NO: 13776 - DNA, 407 bp, Zea mays
gatgattgttaaacgtgagatagattgtgatattctggccaagaattaataggatgaatagaatatatatatatcaataaggtgcatcttatttttcataagtctattttgaaagaatcttagagttaagtgtgtttgacctataacaatctcgggatgagtgaccgaccagaaacttctcgagtgcacatgagtgagaacggatgcatatgattgagaataaagtacgcacaaaagacttgacttgtagtgatgtgtggagatggtatatgtagatgcgaagaagcaaataacgctggtccgcaagtggccgggtgttacaggctcgtaggtccgatcgccggagtcacatgctctgggctggcttctgctgctagctgcctcgctagccgcctagcccaaccgca

SEQ ID NO: 13777 - DNA, 927 bp, Zea mays
gattagatctactagatggaacggagcaaggtgccgccctcacgctcgagaatgtgcactaggacgactagatgcttacggtcggcaaacgacgtgcgtgtatggtgaaaatgtcgctgctactccatagagtctatgataactagtgcttctcgccataaaaacgctttagtacaaaaaacacaaagatagatgaataagaacgacatcaccttgattgcgagatgtagtcagggtggcatgtcacttacccatggaaaaccctaaaaacaggggcaacgatgcgccaaaagcttgtggttgcaaacatgtgaagattcacgatcacactaatgagtgaacaagggtatatatttatagtccaaagacttgtgacctccactaaccctaatgcatctaggttggactctatctttccatctttaagcttatcgcttaaactaacctactagatacatggccgattcggactgggaaatacatgtgcaggggccgattcttaaactttccttaattgccccttgaagcccatttcagtcacgacccacttccaatccggttaaattatgacgaaaataagtctataatacaaaataatattttagattatcttatgagtgcactgttaaattcggtcttacaatctatttatataatcttattttaccagttgtccgaatatagtaaatagacatagaaaagccatggccactccaaattcctaaatgaacagtcgctcgcttttctcgacacgctgggctgctacgtgtcccgccagtactgggtcccacgtgcccgcctcctttcatcctcggcagtcggcactcccgagtcccccacaccgccgtgttcccctctcttgtcagttgtcccttcccccacttccctttccttcccgaagagacgggcgcagacggcagagccacc

SEQ ID NO: 13778 - DNA, 1049 bp, Zea mays
cataggcctaaaaactattatctttaatcttgattacatagtatcggttgaaaatgtgatgctatagccgatccttttaatcgatactattgaagactatttgtgcagtagttgaccgagggctcggtcgttttggtgtcgctcttcttctactgccaacggtgttcgttgttcccttcgcgcggctcttgtatttctcgcccgttgctcctcgtcccagccgggagccatactcctcgcctcctcctaataatctctgtccagagctgaagatcgaagcccgaggaccgaggtaattaagctactcattctctctctttctctgtcatggttgtagcaagttcatttgtgtgcgtctctctttctcgctccgcagcaagttcgctcgcctcgatcaatcccatccgtgcccgacgaagtgcttgcttattttcttgatcctttcttgttgattttggtgacaaccaagctcttcaatcacgtttccaagagacctctgcaaaaacaagctcttaaactcatacacttccatttttttctcctttttgccattcacgaaccattgaacaggtcttgatctaagagccaacagcacacagacacacacacactctggaataatcgtccgtagaattcccgggggcctggccttggtttggttcgaaggtcagacagaactgccgctctatgcgttggaagacacacttggcctcgctctgctgcccgttgctacgagctgccgcttataagcatcgggcacgtggcaacggttctggttttttttcacacgccggtcatggtcgtgcacagaagcggagggccggcaacttcctttcactttcaacagcagactatgcgatcagaattttcagctgaatgatgatataaaaaaatgattctcttagacttcgtcgcctttattgcaggcgttgtatccaaattgggtacccatatttgaatgacgtctgttgcactggcaggtggatccggccaggaccttgaccaggctgctgagtttccatccaagatcaggacattgcgatcaaaac

SEQ ID NO: 13779 - DNA, 82 bp, Zea mays
ggtggtcatctcgaccactgaattacaaaccaaaatgctgtcattacaaagtttactatgcaccatttttttcttgacaggg

SEQ ID NO: 13780 - DNA, 391 bp, Zea mays
ggtacattcaaatatttttcttcaagagtttgcaatgtgtctatctgtttatggcaagaatggatgcagtgattcagcaatgtgcagtgcagttggaccattttctatggatacacaaaagaagcaccttgaaagcactgcaaagttaacacacattgaaggtccagactctggtgttttcccgtcccactgatcattgacttgtataagttatactgcttcccttgtgacgaaggataaagcaaaaacatatttgttggagagccacaatgagtttgagtttgagattgggacgagtgctgttagtaatcagcttgaatcatgtgtaactcagctgtcagtgaatcaaactgcacgttttgtagctgaactgcctcctagggatttaatc

SEQ ID NO: 13781 - DNA, 1074 bp, Zea mays
tgcaggcacagacaagagttaggctgttctacctgatcatatgaccctccagcaattctctcatccacacacaaactgaagcaagaattattgcttatctatatcctgtctgtcctttcctctatttcccccctcccctttctatttccattgtgcagcttgttattagtagatagcagtggatcgatgtgtgatggaggaaacaagctagctagctagctaccagctgaagcagcagggagaagaaggatagagagagagagagagagagaaaacatcttcttcatccatagtctcggcctttcttcaccaggtcgtctgcagatctgtctcctgtgaccttccagaggtgaggatgagcaggtctctctagctcactgcgctacatgcccatgtatgagaagttctattttagaagacaaaaaggctttgatctgcagtcttcgttctcgtcttctgggttctggccttctcttgcttggcagtggcactattattatattatctatggttcttgagatttgagcaaataaagatcgcctttttttcctttaaaaaatctgtgcttcttgtgccgtatcatcatacatgcacacccacgcatttgtacagtggatcatgcatcctccatttgtgttcatgatcatgctgttgatttgcactgctccctttatcaataattttccgcagatgagaaatctacagtctcattattgtcccctctttctttgtcccaaggtaaaaagggaagaacagaacttccccatttttcccaaagattgcacatgcatagctggctggatcagagcacatcacactccgaaaccctaatcttctccctctcctcgtgcctttcccagaacaatatataatcctccgtccaagaaaaccctagccctaagattagtatcgaaagatcgcgatgcatattattcacagctcagccaccacaccaccatatgtagagatagatatacgtatatttctttgggaaaaaacggataataatccaactaattaatcaacgtttttctactgatttattcgcaggccaagctaggccaggaaggaaaa

SEQ ID NO: 13782 - DNA, 392 bp, Zea mays
ggtgcggctgctgcagctcctcctccactggccagtcaccggcctccgctgcaaccgctgctgagaccttgcttctacgcggacagctgggaatggcttcctttgtctcaagaggaggacgggtatgcacgggagcggccggaggaggataagtgatagcggcggcgacgacagtgaggaagacgccatcggaaacatgccttctgcactgccccctctgctctgctgtctcgcggcttagcggggataagatgaggagtctttagaaaatcatgcacactaccaggtgaaaacagaagttgtaaaggtactcgtgaaatatcctatagattgagggtccgcatagcaaaagagaagttaggccttcttgtccgcttgtgttggcggcggcg

SEQ ID NO: 13783 - DNA, 286 bp, Zea mays
gtccaaacagaacctaaagtgctacaccatggacgctcgtcgctcggtcctttgtttgaggatactgacgctcgtatctaactagtaatcgtatgggccggaccaaaatttcggatgcagcccaacatagctagttttcgctgaagcttctggcccaacatggcccgatcgccgccggcgagcgggtcttttctgctcgtacttgcaccattggtccattgccctaaatcctaaccagaattaaacggtccaaaccccaagcccctcctcgcctcctcggccacgc

SEQ ID NO: 13784 - DNA, 1019 bp, Zea mays
ccttatgaaccagaggattatataagtaatatgcgatccgtagcttccgttgggcaataaagaactgaagtttccctgcttcctgaaaacttttagtttgcttcagagtttcaggcttcagtgtgtcagtttatctggaccgaagtttcgtcccaattttcgtctcctgcagcatgacgtgcatggttttaaaaaaaacactaacagaacatagcacagtatggcacagcgtggattttcagtgtctattccaattttttttacagcaacaatttgaaattcatcgagtgactactgactagtgcaaatatgtgcatctttcagtgttctgatatctgttcctatctaatcgcatatatcactccccgtaactaagaaggaaaccagctatcagattttagtgttcaatggtttagtcatgctgtccagtgactttctcctgtagtgtagtcatgcatctttcagtgttctgatatctgccagcctttcactgcacacacacaaaaaaaaaaaaaaaagagtccagttgcaactagagaaagtaaggtgctaacagctgaaactgaaagtaaggtgcaacaatacatcggatttattgtttgggtttgcctaggttaattgcagattcatatttctggaaattagaggccagccactacttttgacttgacgacagtcacagggcatgatgcatcatacagcacataaattcgtccagcagagtaaaaacaataaggaaaagctagatatatgcaggtgatacgcatgctgtatcatttcgtcggcacactggaagttcgagccgtatttcgtatatgactggactgcgttttgtgtctgatggagtgatggatcatgaccaacgctttgcgtgtggtgattctcagaacgtcgagcatgtcgcgagccttgaatggttgttttgtttcagggagaactgctaatgctgttgctacagcgggcgtaccttacctttggatctggccgaggccacggctagccatgacgagcgactcgag

SEQ ID NO: 13785 - DNA, 265 bp, Zea mays
ggggtggcgccatgacgtaacggggacggctgcatggcggtggcggcacgtggatgagttctgacttggagtacatcggcattgcttcaggtggttgtgccttgtcgagacgttttgatcttggaacgtgggcgtggtgccctggttttataggtaggggcagtcggacatcacgggcgttcggacatcggcgaagcggaccacctttcgtcaaagtttgcaacagaacggaatatacggaatacggctctgcacagccgacgcg

SEQ ID NO: 13786 - DNA, 85 bp, Zea mays
ctgctgtgttctgttatgacacagccatcacacgcatactgcatacacaacacagagcatcagaaggagctacgatctgatcgac

SEQ ID NO: 13787 - DNA, 1084 bp, Zea mays
ctgcaagtttctcttgtcattcacgtggctactgagatcgatgtaattgtaataactccccaggtgcgttggtaaaagtctgacagtatgactgttaggcttctatgatggatatgtagtctcttcgatcttcacttattcagacagagctatttttagtctaagactcgttcagataatttggtttcgatccttcggatgaataagttaacttttagggcatttgtagagatcaatacagaacgcaaaaatgtcaaaatgcttccagaaaagtagagacagagaaatattgggagaagggtaaaagaaaagtgtgtgttgggcaaagaaaaaccaatgaagaatgcaaaattttaaaacgcccctagctagaaaagtatagacaaagatgtaatgcaaaaataaaaatatgtattacgtaaagagaaagatgcattgaaaagataggattggaaagagagaatgataattattttgatataaagtttggatattgtaacatcaagtattttacgacggagtgagtagatttttttcacatatattttttttgcgagaatttgcttcaacttgttagcatcagttataacctaggtctttttccttgacagttgcagttgttgcatatctttttagagtttggaccaaagtgctctccttcccaactgtacaagtggttctggtggttcttttcaattataagtggctttgaatttttgtagataaataacttatatatatatatataaatacgtagtaaagctatattggtatacatcatatctacatatctaatcatgtctagatacctagatatgcattatagttatgtttatatcaattttcttatgacataatattttttttatatatttaggtatatcaattttgatataacatgtatataataaaatatatgtaccagatattcattgctagagagactgtcagtgtgccatggttattgctgtccagctgcctggtgtttgatgtaggacgtgctcactgaactctgttgcacttcatcacaacaccgacttaattgccagagcaaatcatgtacagtatgcattattaaagacgt

SEQ ID NO: 13788 - DNA, 1500 bp, Zea mays
gatcaatttctcttggaatacctctctttatgcctcaacaagtgtggttgacttagagatagtttgatttgcaaaaacaaaccaagtggtggcaaagaatgatccaaatatgccaaatttgaatcaaaaacaattcttgttctcatttgcattgatgttgcacttctagttgttgctttttgatgtgttggcataaatcaccaaaaagggggagattgaaagggaaatgtgcccttgggcaattttctagtatattttggtgattaagtgcccaacacatgttgagtgagtaattatatgccaaatgatggatgaagtgcgaatcaacaagaaggtatggttctagatttagtacattgttttttgtgtactaatatatttgtctaagtgctagaatcaggaaaagaaaaggtctggaaaagagttggctatgtacagccaacaactgctcagtctgggtgcaccggactgtccggtggtgcaccggacagtgtccggtgcgccaggctggcttctggcgaactggccactctcgggaattcgtcgacggcgtccggttataattcaccggacagtccggtggtgcaccggactgtccggtgagccaacggccgccagcgcaacggtcggccgccaaatccgcgggcgacgcgtggcccgctccaacggtcggcagggtgcactggatagtgtccggagcgccaacggctacaattctgctacggtcggttgtgctattttaggaaggagatccgcaccggaccatgaatagtggatgtccgttgcgccacccgacagaaggcaagaattgccttccaggaatgcctccaacggctcctagctgccttggggctataaaagggacctctaggcgcatggaggaggcacccaagcaatcattgatcatctctaagcaccaagactccattctcgtgcattcgattctttgagatagtgacttgagcaccatttgagtagagaactcctggagttgtgttgtgagctcaagttgtggctttgtgtgcgtgattgtgctcatactttgagtcttgtgtgtgttgctcttcccacccttacttccgtgcttctttgtgatcatcaattgtaagggcgagaggctccaagttgtggagattcctcgcaaacgggaaagagtataagaaagaaaacaactatggtattcaagtggatcattggatcacttgaaaggggttgagtgcaaccctcgtccattgggacgccacaacatggagtaggcaagtgttacttggccgaaccacgggataaatcatcgtgtctcttgtgcttgctttctttgtgatcattgtgttttacaagagcttggtccttagccacttaattccattgtgctaacacttaaccaagttttgtggctataagtttaagtttttacaggatcacctattcaccccccctctaggtgctctcaattggtatcagagccgttctcttcacgaaagggactaatcgcccgaaggg

SEQ ID NO: 13789 - DNA, 1500 bp, Zea mays
catcattcaatacttgagaccagccagtattgccgtgttgctgcagagaggttaatggcacgcacgcatgtaccgagctttcggtactggtccactatctcgtctagatcgtcgtcctccctccctgtacacggcactactaaaaaccagatgtgtcatgcttggaacgcgacgtgttctttccaaaccccttccccagaccccacgctaactcctttatttctatgtgccgtcggcccgtcgcgaacaaaggagtaaatcaatccggtacggtgaaaagtttgcaaaaaaaaaaagcgaaacaaaaccgtttcttgaatgtgtgaatactccacgaccgacgcgtcgcgttccgccgcgtgcgtgcctcggcgttggcggtcgttccccgcggaggcgattttgtttaggccctgttcggttgttccggattggaggcccggattaattcctagccggattacttctctaatttatatagattttaatgaactggaataaattctggctcattccggtacaaccgaacaggcccttaggaaaatgtgattggacgtgcgcagggctgcaaacacgtgctttgaaagccatcatgcacgagcaacactggagacgttactgggttacggagcatacaccacgggggcatatggcagagttctcgcagttctgctcgcacaaagaatcaaaccaggctaaccagcacagtcagatgacaaaaaaattgtcctatttcatattgaaagcaaggcgaatctagtatttattttatagtatagagtgtgttagtatgagacaaacaaaaatatactcaacgctgctcgcaatctgctctccaatcagactcatatataatacttttttcgtttcgttttagttgtcgctagatagtacaaaattaaaatatccagcgacaaaaaaaaaagaacggagtgagtaataaccagaaaagtaaaacctttgaggctttgaacccgtcccgtcctgggcacctggtcaatccacccatccgttgcactttgcacggcggtaatggcagccactcgagtgattatggtcgcctccatcaaaaggtttgacccccgagagttaccccgtcccgttccgtgaacctatagatgtccaaacgggccacccggcacggacccggcccgaacccgtttcggcccggtacgaatagggtcgggccaggcacggcccgttgatgcttcgggccgggtcgggctggcccacgtgcctagagacatgcccaaacccggcacgcacggggaaaaatcgtgccgggccggcccgttggcccggtgggcctcaacggaccgggccgggcactggcccgaaccaacagtagaacggtatataaataaatatatttaacataattaatcatatataataacatattatttatatatattaagacaacaaaatattcatgtatgcattttatatttatgtatgcattttatatatgtttggccgcgtatttagtatttacatact

SEQ ID NO: 13790 - DNA, 538 bp, Zea mays
caataataataaatgattgttcatattttcttttatattctttatatttcatccttcatcattgtttgatgaattgatgaaggtgtgaccttcatcaccttcgtccgcaagtcattatatcctaaaggaaataatgcttcggaggacgaaggatattaacgattaacattttctatgttgccttgttcttaactcttagcatttgagaacaagtccccaacaggatggatacccatagtgctagaatggcttgttacctagaggccgttgatctaggtgtttggagagtcactcgtgacgggatgaaacccctcaagaatcctgagaaacccaccacgagtgaggaaaaagaaattcatttaagtgctagagccaaaaattgcttgtatgaatctcttagcatggatatttttaatcaagtatttaccttaaaattgctaatgagatttggctaaaattgcatgagctccatgacggcacatccaatgtccgtgagcaaaaacattgccttgtcttaaatgagtataattcttttgct

SEQ ID NO: 13791 - DNA, 436 bp, Zea mays
ccccccccccccccccctccttctgttcaagcacgtatttgtttcccccacaggctacagtagtacacaggccacatcatgaagttcacctcatactagcacgcgctctcaaacagttgaaaccaaatgaataagcgtaacctttgctcggaatgaaaccaaaatgagtgcaaattcgacgtcgaggaactcgcctgttacccgttgggctgttatgggcctcaataagacgtggcccaacttaatcaaggtgaagaattctaagtcggttaggcccacgtacctaagcaccccggcggtcgcccggcgccgctgcaggccgcagttgtaggtacagggacaaatccccggttctttctccaccctccgaccggccggcggccgctgcaagtttcaccgcagttggcaactggcaaccccgctctgacctaggagg

SEQ ID NO: 13792 - DNA, 264 bp, Zea mays
  unsure (1)..(264): unsure at all n locations
tatgtagtccacatatggtagtatattataatggtatttaagtgcaccacccatcatcagctcatatcataataaaagcctatacaataatgttgtgtggttatgatagcattaccacgcatgttccttcatcaggtcatccattctaagagacgttaagttncacaaagcttgggcattttaggtggaaaacctgggacgtcaacatacattgctggggtacaagaagatagggctctctacctagatccccatgacgttcag

SEQ ID NO: 13793 - DNA, 755 bp, Zea mays
ggtttcttcgtgattttccatctcaaatagccaattatatagtgtcacggggccttcggtggaaattcgagaaaagcattgcgtggatttcagtgcttttgcttctctatcccactgatgaaattcctcctttctcagagaagaaacaagaaatgtttttctttacatgaagacatagatggtcttatcttggaggacatatcgtgtgcaatcacttatcctggtacaagtgtgcaatcaaacgatctgttgcatccgatctagatccaacggttttatatggaaggggttaaaagtaaaataggtactatgttttaggtggaaggggttaaatataaaataacagttatcattagatctagatcggatgcaccagattgcttgattgcacgcttgcaccaagataaatgattgcataggatatgtcctccttatcttgatcccaagttaaaatggagatatttcaaggtgccttagtgccatgggccaaatcatagtttcatgattgagacatcaacaaaatggtctacttgaatagttaaatatagaaagctcaacagttccccgtactgaattctgacctctaaagataagaacagataatataacaaagttgaaacggcagaagtcactttcagctctactaatgcagtagaaattggaccttttcctaccaactattccccatatttataataagaccgaccagtctaattgcccttctggttgatgccacgatttcaggttctggaagc

SEQ ID NO: 13794 - DNA, 752 bp, Zea mays
gctgcaacagtgtcagcttgtagccagccgaacacgccctgcactgctggagcgtggaatcgaacggcggctttcccaagcggcttcgcttgaactgggtcggaacctgcccggctcgattcgttttgggccaaacaacgcggatctcagcgtgggctacacgcttccggttccagatggcgcgtccagtgcactccggctccgagtatccacggcgtgtcaaacgagtggtggtcgtcaaagtaaaattccatattgcttgcacgtagaccatgacgttgaattactgtggatagtaggcaactagtacgtgtgtttatatgggctgggctataatctgctgttggtgggcgcgtacaaatccccgcggcctgccacggtgcgggggcgcctgcgctgcgttgcgcgacgccaccatcgtctggtctcgtctcgtcacgacacattcggaaccgcaaaaaatcgcagcggctcaaaaagggaagaaacgcgaaacagacggcgcaagccaaaacaaaagtaaattcaggaaaacaaaattcgaggtcccgtgcctggccaggcctggccgctctcgtcgatttccgtctctctctccattttgcgcccgcacctccccacctccacctcccctcctttcggttgttgtctgacttgtctcctactctcctcgccttcccccttgccttagggtttatcccgcgctccgcctcgctccgtccctccctgattcgcgcgatctccgcgcggcc

SEQ ID NO: 13795 - DNA, 1500 bp, Zea mays
cttgttactcctaacgatcaatatcacttagatggtttrgtggtaatcaagagcttggtgatcacctggtgcggattgtgagtggcccaacaaatggtgtaaacagttgcttgtgacccaccatgccagagtggtgaagaaccaacccatagagagcacttggtacttacatagagaaaggtggcacacccttgcacgggtgctccaacatggactagtgrgtactaggtagtgacaactctctaataccttgggaaaagttcattgttttcctaaccctttctttactttgaacatttacttttatgcagttagcttcttgtatttacattactataattaccatactagaatagagttggaacttagggagcaaaacttttatgtgaaggatagaaaacactattaaacagaagagataaagtaggctatttagtaggatttaactattacgagaaattttatattagaccaatttatccttctagcttcgcttagtttctgggtagctccttgccattcctgagagaactcctccctatctttatggagaaggcagtggaggagctttcgtagattttttgaagctgtcgaaagagcctttgaaagagtactaaggttgtccatagcagatcatgtaaaataagagttttgtattgtttatagagtaaagtttaaaataggtgataagataggataactgctagagctaggctaacaaaagcgaacaatgaaattatatttttcctagaagaaaggaaaaggtttgctgatgttttgaatttcacacaaactaacatgtttcctactacgaacatcaggtcattcagtttttattcgacgggcttttttgagaatgtagatatctggagaatttagttgtggagaaaatctgaatatcgtaggattatatatatggagcaagacgaatgtgtctatagggtttgagatttaggaagtaacggatttcttccatcgtcatgacttgatgaattatgtgttcatattgatttagacgatttttatcaaaataattattacgtagaatgttagaagtcgattccaaggatgtattcagtcgttcctctatcttatcacatattttcaagtttactatgcaaacagtgataaacattgacatctatggtatcatgtcactgttttataggatcaatcaaagacaaattaagctgaacaaacacccccgacacctgttcatccagggtgtgtttggtttgaggccaaagtaggacgaggagaggacaacaccgtccctattaatttttttgaatcatgccatcataaaaaattactctgatatttatctcaccctcactttggtctcatctaaacaccgtaaaattgtgatgcccccttctatccattcttatgatcaaaccaaacataccactatagccgtcgccaatacccgataagactcggcaaatcagctggacacatagcacatctatcccgcttccgtctcccgctccagtcgcc

SEQ ID NO: 13796 - DNA, 691 bp, Zea mays
ctctagatgatccccttgttgtagccagagacatccgatcatctttaactaagatccactcattattttattagttagtttattagttggttcaatacaactaaaatcagatgatagccattgcaatttttcaccaacagttttttagtaactctggcgcattcaagtatacccttactggtgaagcgcattattttttaaaaaaatctgaaaggttttccgtttagacacaaacggaagccaaaaagcggatgaagcgttatctggtttctcaccgactcaccctgcagattttgttcgtctccctctcctttgccttgcccaccgagaaagaagagagagagagagaaaattcaagcaggcaacccaaaaagaagaggaaaggattggaaaagctagggttttcgccatggccgtcgcccacctcgaactcccctccctcgaatccacccatcccacgctctcctagctcccgcatctcgcatctccacaaaaagccgccgccttcgattcccctccccgctgcctcgcccccattcgagggtttcccctcctcccccccctaaatcgaaacgcagcattaccgaccgagcaagcaacccaccamcccacccgctttaagggtccgagccgagcgacggcgctggcgatccagctgggcgtgagggcggcggaggcggccggataatca

SEQ ID NO: 13797 - DNA, 1338 bp, Zea mays
agcaactgataatctgatatgctggtaatcgatagccctctgtatattgtatgtgctttatatgtggtgccttttgctctatttttttttgaggaaacagtagggaactaaggccgatccctactgaaatagaattaaaccaaaacaaacaaaagtacagaacggtacagcacaggttcaggagacaaaaaaaggagactaaggggaagtgtttctttgcgcgtagaataaccagaacaaaaacttcctgtttacagcgctcccaggagatagcttcttctctggaaatgaagttatttttgactgaccaaatactccatctccatatagaacgaaaccttgagctgggctctaaaactttcaaaaatctccagagactctaacgagtttggcacctgaaccatgggggttgtccatggtgccatctgttgcttgctctagaggttaatagatcagctgtattttgcccccatcattggcccttgggtgtcactctcacctgtgccccgctcccgcgagaatcggtctcaaagtctgaaccctctcgagataggctgtaggccgaggccctgcgaatgtagcaggcgtcgccctggcttttgcctgacgagcgcctcatccatcctgaatttctcgtgctagcctagtaatccccaacttgaaatgcagcaatgtaacgttcagaaatggcgcggaaacgagcatgccctcgcagtctccttgcgcatcatatttcttcgcgcccacacgcatggggggccgggtgatgggcatggccaaatccactttccaaggctgcagcgacgaaggcgatttcttgcacactctcactcgcccccgatcgaacgcccggtgcgtgctctgcctctgctggtctgatttacctactgcaacacgctattgcagcaccattccactgcgccgcgcagcacaaccgtcgcaagggacgagacctcgcatcgcaccagcactgcacggcgcctcgcctcactttttctcccccctcgtcgtgttctcttgtcagcctccaacacaacacgcacaccctcccctctcccccgtcccctccatcagtcacagtccatctcgccattgcatttgcctagttcaaaaggcctccgaagtcgcacagttcctgccggcgcagggtgccggcctcgtacatacaaaagccagagccagacagtgtcactccagagctggctagctagtaggctcctcccctccccctcacctgttcgtctgttccccattctacaatacagctcgcaagggatcgcgttcacccctcagccaccggctagcagctagaccttcaggaccttgctgcattccccc

SEQ ID NO: 13798 - DNA, 398 bp, Zea mays
taggatgaatccttgatgtgcatgtgcattattggagagaaaaaaaaaagaaatccttgatgtgcataggattggcgcgttgatctggtgattccaccggaacttcctgcttggaagcaagcaatgcaagcattccatgagtcccatgaccccgccacgtgcactcgctatatttgcgctaaaataacgcaggagaattctaacttgttctctcttccccacaacggagagtttgagctgagctcacgctcgtcatctaactctccccccattcgcaatccaaaaagcttgcgcgctactccactggtccattacttacgcagtcagttcagcgagtgagcactgagcagccatgtagcaatttcaattgcaagttgcaacgcgacgaatacggagcc

SEQ ID NO: 13799 - DNA, 361 bp, Zea mays
tatcggataaaaccgatcgcgtattcgggtttcgggtacccatcgccttccctaccacgaatgaaacgatcagtcgcctaccaaggaccgcgtccatgcgtgtggcgacgacgcctacccccgcgcaggccgcagccccaccgccgcgttccctcctccccactcgtgtgggaagctcagcacaaagttcgcgttgcgccgggcggctcgtccttcttggaaatcctcccacgcaatcgcctccccgccccgcacccgcgtgcgtgagacgccgcctcgcactgccacagtgccaccgccgccccccaccccggggcgccgatctcgcgtcgcgtcgccctggcgaggtggtggcgggagg

SEQ ID NO: 13800 - DNA, 210 bp, Zea mays
tgccggcggcacgaaacaccaacgaacgcaaagagaagggatctgaccgattgggcagcgatgggcgcaagtaagggatccgaggagtctaggagcttcatacccttgcaaccttggagagcgtgggccagcgcttagcgtcgacgactgcggtgcagttcggggcagggtgcttccaggtggagtgcttggccagggagacggagggag

SEQ ID NO: 13801 - DNA, 179 bp, Zea mays
cgcactcagacaagaaatcacagcaacaccacgcacacaagtcgcaacgagagctcacaatacaactcaatgagttcaccactcagcaagagctctaattgctatcgcaaagaaacaaaggcgcagaatcgatgtcttggtacttaggaatgttgtaggaatgcttggtgttctcctcc

SEQ ID NO: 13802 - DNA, 118 bp, Zea mays
tgtgagcttctctgccacgtgtcctctttgatcacacagcacgccagctgcggggaagattatcctcttcttgctgttgctcacagctagccataacaaccggtaggcactggcgagc

SEQ ID NO: 13803 - DNA, 282 bp, Zea mays
tgaaaggttaaagatgaagggtgaataatgaggtaaaaggtaaagggtgaaaggtaaagggcattatgacattaacatctaaggattcattccaggcagattaactgtatacgcttaaccttatacccggagctggatatcagaaatcagaaaggcgcagcgttggcaacgggattgattatttttaaatagtgttgccgaacttcgtttcatcgagaccattgaagatcatgtgcacgagataaacttcaaatccgaaattggaaatttcaaatccgaatt

SEQ ID NO: 13804 - DNA, 543 bp, Zea mays
cgagtgcccgacaaaagtcactcggcaaagagtccgacactcgacaaagtctcggattccggtagtgaatccttgaacttagggtttagaaaaccctagtatgagaggattactctctgaatttctcgatctaatctggctcggggtgatagacaacgaggtaaatctgagtctaatcactttgatccgagacgacctttctttgattaaaacaaatgcggattagcagatttaggggcttaggaattgatcctagccaccctagaatctaacactgctgagttctgacctgcgttgcggattcgaagtccgtgggggcttgcaagagaatcgagcagtttggtgagggaatgagggcgctcacctaacgactgctcacgcggaccggcggcagtactcgtcattgtcagcagtacaaatacctcacttgctaacccatcgcatcgccgagctgttcggtgacgagtggtagctagctagctagctactactgtagtaggtaaagcctgcggcgctcgagcgagcaggaaggcaaaggcaagc

SEQ ID NO: 13805 - DNA, 1500 bp, Zea mays
gagaaagtattaattaacatccaaacatcgatgtgatcataaagattyagacagacccgtagatacgtcggtcagccagtgcacggaccctatactcatgtctgcctctaaactgtcattagcattcgtcttcttcaaccccggcgaaacactctgtcagtctgtccattgcactgttataaccactctccagcatgcaaccaagcatagccaactcgactatgcaactggtgagtcatatttcatctttgttcgtgagtccaatcttatcggccccaaatcaatttcttcctcctgactgaaactgattataccatgcttgcatcaatcaatttacttcatctgcagcacacaaactattccttttcttctttctaggattctaattatactcactagcctgttgtttaatttccctagccagcccattccgcacggaaagccggtggcagtgctcggtcgcgccgggccgtccaatccaaggggtcgtgttcgctgcggaacctcgccatccttgccatggtagcatggagcttcttcctgtacctgcacttctcgttgatcagcggtgcggaagaggtgagcaacggcgacccgtgccgggggcggtacatctacgtctacgacctgccgccgcgcttcaacaccgacatcatccgggactgccgcaaagccgggggccgctgggccgacatgtgcgcgttcctgagcaacggcggccttggccggccgctcgccgacgacggcatggacggcgtcgtcactggcaaagctgggtggtacaacacgcacgagctcgcgctggacgccatcttccacaaccggatgaagcagtacgagtgcctgaccaaccgctccgctgcggcctccgccgtgttcgtcccgttctacgccggcttcgactctctgcgctaccgggtgggctacgacaaggccaccagggacgccgcgtcggcggacctgtcgttctggctcaccgtacagccccagtgggggcgcatggcggggcgcgaccacttcctcgtcgccgggcgaacagggtgggacttcaggaggaggagcggcgccgacgcgaacacggaccggggaaacggcctcctcctcacgccagccggccggaacatgtccctgctcgtgctggagtccacgctggaacacggcagcgacttctccgtgccgtacccgacctacttccaccccaggtcggacgccgacgtgctccggtggcaggccagggtgcgcgcccagcaccggacgtggctcatggcgttcgtgggcgcgccgcgccggaacgttccgacgagcacctgggtacgggatcacgtgatcgcgcagtgcaaggcgtgcagcgcctgcgccatgccggggtgcgcgcgcagccccggcagtgcccagtgccacagccccgccagcatcgtgcggctattcgagaaggccatcttctgcctgcaaccacctggcgacgacggctccagcacgcgacggtcggtgttcgactcg

SEQ ID NO: 13806 - DNA, 389 bp, Zea mays
tcataggactggagttgcatttgagctgtaattttgaagcttttctgaaaattcattattaagctttggattctgagaagctaattattagctttctaaactttacaagctatagaaattctataaaatcataaacttagattttctggcatgtttgctttccagaagttaaaaatataactatttttttagtttctaacttctcacgtggagaagctgtcgtcacgtgaagctgccgagaagcccaaacaaatatggtgtaaatccagcttttacaggctagcttcccaatttsaaagaatccaaacaaaccctagcttgaggagtagaagttgccgaaccttattaaaccaaacgcaaaccctagcatcccgaattcgccagtcgcc

SEQ ID NO: 13807 - DNA, 108 bp, Zea mays
gatcacgtagtcctagcggagggcagtagcaagcggcgcgccgcgcggccaatgggaggcgagtggccggatcggtgacgtgcctaaaaaatttcagatcccgcgcaa

SEQ ID NO: 13808 - DNA, 1500 bp, Zea mays
ggctgagtcatcaagggtcgtgccctccgttgtggcaacggttgtcggtgcagaggggacccgggcttcaggaggaaggtaccccatggctcagcacaaggaatcggtatgggtaagaatcactctgccattagaagctctgatgaaggattctaatgaggcattcgactctcagcgctacctccgcaacaagaggaaaaggagaagatcgaagaaaggaaaggaacgctctgtcgtcggcaccagtgcgagacatgagtctcccatcccacctgatgatgctgatgccaaccgctctccgaaggtgcaatgctggccgtgggacttccagccgttgccagatgcttcaattgatgcttcatgtgttatggttttttctgatgagatggttcgtgaggaagttcgcttcgccgggccttgtttgtcacaatcgctggaaccagacctgaggtactaggtctggaaagtctagaagaagtggctcgtagtttcgacgtcgacattaattcaatgacaatccatcattccttacctgaggacttcctgttgttcctccctgactaagaaacgacaaccatagtgctcaacgttggcaaggtatttaggggtcctcgtttcagtttactgttcaaaagatggtcaagattttcacatgtttcctcttcaaccttgcctcacttggtggatgtggagatccgaggaataccacaacatgtttggtttcgttcaactgcggaaatcatcctaaagattcttgtttcattgaagaaatccatccggacaccttgatgaagagggattttccatcctttgtcgtgagagcacggtgtttcgatccagaaaagttgcagcgagagatggacctccatattgctgagctaggattgcaagtcaacgaaaaaagatgcttatcctataaaattagagtgagggttcttcagggagaccgacaaaccaggatcatggttcctccgcatcccatcggatgacgacaatccaccgggcggatcaaacggcaacgacgatcaagggcaccaggactctcagcctcggcattcgggcggctcacaggatcggcagcgagtagctcttcttcgcctgggaccgcagccgctggttggacgacagagtcatgaatgcacctggagaagctgatgtcaccacgcctgtagcctagcggggatgaggctgcacctttggtgcaagattttcggttactgtctctggatactactgagccagcaaccgaggagtcgctggagaattatctgggggcttcgcagtttcccaatgacgttgtcgtgccccccgtggagaaggtgaatagtccccgatacactgtttatgattgatgccggacaagccccggtgggccgcagacctcagccacgtcattttcgcctcaacccatggtggttgggtcgctggaaatgactgggccaagatcgctgcaccctgcggactgtccccctcctatrcctctactcatgctgcaagaaa

SEQ ID NO: 13809 - DNA, 639 bp, Zea mays
ggtcgcaaatagatcataaatagattatgaaatggatcataaatagattatgaaattgttcaatctcaatttattttgttcttttatttagtatcctttccttttttgggcaatgtcttgtttgataagaatcacttgattgtagtatggatgggcctatatttatttagtagaaaaatatgatcgtagatcaaaaactgctgggtgcctgggttacatagaagttggacttctcagctttttccagtttattttatttttttatttagtagcatttcgttaattccagttctgttcgttacaatgattcctgttggtggaagggtgtttttcacaaatatgaagatagccttctcagcactgagcttgattctcttcctaacaacacacacgaattgtccaactgtaagatctgcagggacgaggtacctgcaaagtgatggccatcagaaaatcagaacagcttatggctgcaactcgcgtttgatgtgtgcaataatgctttaatgcagtagcatttcttttcgtacagaacggtaacatgtctccttcagtcctatatgaaactaaaatcaccttttgtaattgtagaccatgaaacatggaaaccataatagatattaaactcagcatggaacg

SEQ ID NO: 13810 - DNA, 927 bp, Zea mays
ggcccgttcggttgtacaggaataaaccatgattcgttccagctcatcaaaatctatataaattagagaagtaatccggctaggaatcaatccggggctccaacccctaaaaaccgaacagggcctaagtgaactcctacagtgaaccaatcagagttcagagggttaaaagctcacatggaagtatggaacacgttacacgctagagcacgtccattattggcattcttcaaatgcgaggagcaggcattattctaaattataatccagccttccagccagcttgcatccaagtcagagcacgcaggatgccggcaccacaccactgatgatgatgcgactggccaacgtgctggtttgtggcggcaaccacagtgtcttctcctctctctctctctctcagctttctgtcacgacgaccgtgggggcgtgccgcgtgcgcatttagcagcatacgaatcacgatacggcccgggtgccgttctgattgcccccggttgggggtccgggaaggcgtcgtgcgcccccccactacctggaatgctcgatgccccaggacgcaacggctaggaaccagcagccagcatccgattccactttatactgacggtgcccgctcaaactttttgccacctgcaatgcaatccgcgcacgcaggattcgtgggttaccaaccgttgactccattcacatatacacaatggaaaagattgtcaactcgtcgtcgttgtactcgagcccgcaagcaagaagcggtaactgaatgagatagattcacaaggtagcaagtaagcccaatcatcaccgattcaccagcacgacccccccatcatttcttgccttgcccgctctctctgtcccggggccggggccagacttggcagcaaagagacgcgacagcgccatcagccagccgccacgccatcg

SEQ ID NO: 13811 - DNA, 1401 bp, Zea mays
ggtcgcaaatagatcataaatagattatgaaatggatcataaatagattatgaaattgttcaatctcaatttattttgttcttttatttagtatcctttccttttttgggcaatgtcttgtttgataagaatcacttgattgtagtatggatgggcctatatttatttagtagaaaaatatgatcgtagatcaaaaactgctgggtgcctgggttacatagaagttggacttctcagctttttccagtttattttatttttttatttagtagcatttcgttaattccagttctgttcgttacaatgattcctgttggtggaagggtgtttttcacaaatatgaagatagccttctcagcactgagcttgattctcttcctaacaacacacacgaattgtccaactgtaagatctgcagggacgaggtacctgcaaagtgatggccatcagaaaatcagaacagcttatggctgcaactcgcgtttgatgtgtgcaataatgctttaatgcagtagcatttcttttcgtacagaacggtaacatgtctccttcagtcctatatgaaactaaaatcaccttttgtaattgtagaccatgaaacatggaaaccataatagatattaaactcagcatggaacgatggaaattgatgcatctttgatagatgaatgcagcagggttcaatgctatgcattatgttcattttcctgggttagtgggctttgacaagaattctatgtgtacttttcattagttgtttccttattatcctgtttaaatatttattgtttatgtgtcctggcctccaattttgataattactactaacatactctaacaccctactgtaaccagtggcagagctctcgcctcttggcaaggtggggccattaccataccttgagtttcttccgtacctattgtaattgactgtctacgccatacctcaattcccacctgtcctctgctactgcctgaaatatccttttttagggttaatttgggaacccccatttttcgaagggattttcatttttccaagggaaaatgaactaatttcccttgggaaaatccgaaaatgtggttcccaaactagcccttagggtctgttttgaaaacgggatttgaaattgaactaattcctatgaaatttctatgaaaatcgccaccaacctatcattcttaccttcttctgtcatgtctctaatctgcatgtagcgttctgtaagaagcatctaaatattttggccttgtttatgtaccttatgttctcagcaagcaatgtgtaaacgatgaacgaggtcatttcactgatgtatttttggacatcactgtccaaatgatgtttattggctgatcatcttttttacttgtgtaggtgctcataaaagaacacatgtg

SEQ ID NO: 13812 - DNA, 547 bp, Zea mays
ctcatcttctatgaaaccctattatattttcttcattaaattatatattatgtcattatatttgtttatatggaatgtctttagcagttatcctattccaccttctattatatatttgatttcaaactttactatacaaataatataactctctattggacggtcctaggaaagctatggtctcctccttccgctttctcccacccacctactttaataaattcctttacggccactagacctttctactcgtctagtactcctgctgaatccgcatccgatccggccttgccgccatatataaacacccccacccctcgaagatctccatgccctccactgcagcctgcaccacacggcccctggcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactag

SEQ ID NO: 13813 - DNA, 82 bp, Zea mays
tctagttcagttcacgcctgagctttctcagctcagttcagttccggcatatacgtagctacgtggtagcctgtttgtggag

SEQ ID NO: 13814 - DNA, 1500 bp, Zea mays
gtgcagtcaggaaggggggaaaaccttgcatgcatgtaaattttgaggaaatcatgtgctgttgtatattaggaatacctttgcatttgctggtgcgacgcctaatcttcctgtctattaaccagagtgtttatttggcaatgtatcatgaacttgtaggggtttttttttttagaatttctctcttgtttgtggtgctgttgtactttacactgtactcttcattaaagaacttggtttcacttcgttattatactccaatttgaagagcttgaagcttagtccttacgctgcagaactcaataggtcttaagttttaggtcactcattcactataatgtttttaagatacaaggtcatgtgaagtccgaattgctctaattttaagttgtttcttctggcaattttttcagaggtttacatctttgcgtgcacgttccttctctaccattatcattcgctatctatttttgaacgaacgcattcgctatctatatatggtcacatctctacttcgtctttgccgaagcttcagtacgcggtgcgggtgtttcctgcctggtgtgcatgctgttcttttctcggtccatcttatcccccgtttgacgcgcctctgtcaatctgctgtactgtgaattttatttgacgtgcataaaatattctggaaacgctcttggtacgtcacgtaccttgagaaggatggacacggatctggattgggaggcagtagcaccctaattctgacaagacaaaaggatggacacgaatctggattaagtgacagtggcaccctaactttgacaagacaactgctgatagagaaagattgaatgagtttgctgtgttgtttaaccacgactaggaagtaacacggagcatgcagctattatattttcataccatctccggtcgtccaaactactgttttgaactgtaaatttaaattttactctttacagagtaaagtttaaaatagtgagtgagatagaagtgaaatggtgggtctagtctcaaagactcttggacgtaagttttagcagtatggaaaataaaatattgtggagtattttaagacagtctaaattgtgaactattataaggcagtcgaaataggagtacctcctgagtcttttttaacctttggacgcagtatttaaatcggtaataaaatattgtggagtatttaaatggtattgattttgaaatcaataccataaagactactttcttaatacgaatgaggccaaacctttcacatttttggcctgactggatcgtacaccggtacatgggtttgagtaaaaacgaaggaaggaagcagtccactcaaaaaaaaaaaagtatccttccactcctcgttctgattcctgggaagcatgaagcatccattcttgaccactctaggtatcatcgctgcaagcgaacgtcctactatatagatccctcatccaaactcaactcgcacatgagcacgagagcagagcgcgtccggccgtttcc

SEQ ID NO: 13815 - DNA, 1070 bp, Zea mays
gggtcgtcctcgctgcgccggtcgtcagggtcgccctcgcggcgctgttcgctaaggtcgccctcgtcgcgccgtccgccgggctggaggaggacgtgcttgccaaggccgcgccgacaatcgcgctcgacgaggaggtggtagccgaagtcgcgctcactagggccgcctcgcctgatctccctatgacgacaatggctggtgtggcggaggccgcactgactagggctgcctcgctcgatctccctgtgatagccatggatgctgcgccgagtatcggtgtgacggaggtcacgctggacagtgccgcctcgcccgcttgacggccatggatgtcgtatcgtcgcccatggatgtcgtatctgagaacgtgattgcgcccatggatgttggatcgtcacccactacgattgctctcgttagatctttgctccccaatatttcttctccgacaatacagtacaatctccatgtacttcctgtccaaaggtgattgttattgttagcgttgtttttaccatgtcatttttttgctatgccatactgctgtccatgaccatctctgttggcgagcagcaccagttgccgagctgtttggcaagcagcatcagttgtcgagctggtcggcgagcaggagcagctgtttgcgtgcagcacttgtcggtgagcagcaagccagcaactgcagtgttcgttcgtgttttctggtggccatatcttcaaataataaatgtgtataactaataaaggggtaaaagtgtcttgttagggaaaaaaatacatgagattagattataaaaaggaaggatatacgttaaatggtagtataatcaattagagaaggtttgtagtacttttttacggattaaatctttcaggatgacattattgcgaagcgtactgtttagaatcctaaatatgcaattgtcttgagccccagaggccacgaactccacgagctctccgcccagagcttctgttcgatgccccctccttcaccacccgcctcgcaagtgcgcacgtgcgatgctggcgccgcgcagtcgcccacgcgcgggacggtgagtgag

SEQ ID NO: 13816 - DNA, 401 bp, Zea mays
atattatattttattagttgtatcttatacttgattacgctgcatcaggattatacatgcacttacgtagtcaactcaaactcagatgcacggaaataatgcaacgtctgtgggtcgtgagcactccacgtgtcctatatacatttttttaagattaacgtgttgcatcgctggcctagaatcgtctggatccagcgtgccacgcgctcacgccagttcatgcacatccacacttacagagttacagttacagccaaccaaccacatcgcatatcaaagaccagaaagctcaaaccaagaccggcgtgcgcggacgaagcacagatccatcggagtgacagcgagcgagagcgagagagacagagagattgtccgcgcgtcagcgactcccggcgaagacg

SEQ ID NO: 13817 - DNA, 230 bp, Zea mays
agtaaggctatctccaacagctcttctatctaattccctaccatacctcccatttcaaacttcaccctacaaacaatgctatctacagtgcaaaaacaatgttttacacgaccatatgcacgatctgttggatacagcctaaggcactcctgcctggattgtaatggctttggtgttgtgcaaatatcacatgctaaactgatttttttttgccttgcgaattgtttcag

SEQ ID NO: 13818 - DNA, 965 bp, Zea mays
tcatcatgtataaatgcaaacgtgggcgacgcgcgcgaccatgaatgaatgcatatgcaatgcaatgcgagttagtactcggctgctgtcaatgtcatctgatcgcaagtcccagctgggagagagaggtagacagacggacgcgtcaaggcagccatgctcgtatcgtgcagtcctgcagatcatcaggtgggggcacggcacatgtccccgtctcgctgcatctattggctattgctactccttgctatctcttggccgcagtacaaaggccaagggattaggtgtgccctctgtgtcagactgtcaacagtgggttgggcgggtggatataggtgatggtttatcctttttgactttgtgtcatctgattaataaccggttaagaaagacacagtttcaaaaaaaaaagattaagaaagacacaaacaggaaatgggcaagcaattgcttccaaagaaaaggagagaagagaaaatggtcacggtcaagcacgggcagcgagacggatgttcttcatatttttccccccttctcttcaaatggaagtcacaacacaagccttgtggtgcgtgcctgaacctcaagtctgcagatttgaccactgcagccgtggagcagagcggcctgaattcttcttctgaagttccaccgcaaattaatccaggagagtgtgagactgactgacacacatgcacagggatcacgccaggtatataaacgcgcaggcggccggccggcccacccaccggcgacggcgatccgagaacaaacgtcgtccgagttggcatctttggccaaacccagtatcattgcccaatcacagatctctcggatctctccctcctctttctaatctctctctctctctctctcacacacacatttcccactacctgctcctgcttcttgcctgttcggtgtgcgctgcgcgaggtgaggagcggagcagggaggtgaagggg

SEQ ID NO: 13819 - DNA, 1217 bp, Zea mays
ggaggtagacctgttcatgggactggagtagcagttgtgtgatcatctgtaaaacgagcgtaaaggatgggcaggctgttgtgtactgcgtgttgtagatgtaacatctcggacggacaccaaattcatctcgagttttctctccatctctgtgttgctcccccgtaggctgtagatcgtttcgacatttgagtcaccctattaaaaacagaaagaccgttcgtccaatttaatttgctaggctgaccagcaagttgaaacaagtcatacgagaggattgcagattggcaggtacaaatgatgaagaaccgtaaagcttcgttctcccatttcagcacatgatagtgttgacgtatgatcttaaacacagcgagaaacataacgaatcggtaaaactaatacaaggatcggccaaatcaacattgacccaattcttcgtcagtaagctctcgaatactactttctagaaagacccgtctaaaagaagcacacagagaatcgacaagaccacacagaacaccgtcaaattttgccgagacaagctgttgaaaatagccttacaatggcagcactgcaggaagacaacatttacactgtcatcaccaatcaaattaggctaacgctaatcacaaaactggaagcatcctagcgtcctgatgtggtttgtctgccaaatttcgcagtttgatggccaattaccataagtacgatgggcacaaatgacgttgcttaactaaccagttaaccattagccctagctgcactgtaccacatcattatctgagatgagaatgatcacacaacacggaacgtaaaaactacaatcaataatatggcagataactacgagaacgacttgagagaataattactaccgccgattaccagactccgatcaatgcagcagaaacatgaaaggtaacaaacatagcgtaaagcataggaaattagtaacacagcccagacatatcagaagacatgaaacaatagagatcttagcaaaactttgcacgacaaggtacaataagtagtaacatgttcagatgattgcacggacattggaacaatctccaaattatagtcgaaaagcaccagcctagaagagagatttcttttgaattaaaaagacatcattctatagactactcatggaacatagtctataaactcaggctgctgtgaaggccttctttccagcagctgcggatccagctgga

SEQ ID NO: 13820 - DNA, 1270 bp, Zea mays
atgatcttaaatcacatgggctacagattgcaaccaaataaagtatattttagttgtgaagcatacgaccatgttgtattcaatgagtgtggtgatacttaaccggtcattatgatgcattggtctctatatataaacttgtcgagggatggaatctagaaaaattgagtagaatgaatatagagaacaaaggagagattgttgggtattctctctaaagttggtcattagagattggattgggcttaacccaactaaccatctccttaatccggtacttgattgggagggcccacgttaacctcagttggagcccccggtcacacgacgctatataaaggattaagggatcgcaggaaagccaacgttagtgcctcgccctaaaccctaatctctttagtagttagagagtggggagcaggataggagcggtgggaagcatgtttttttggctcgcactttctagtacaaaatagagactagatacactccactcacattatagggcaattcaactttttaccatttaattttgtgggaatgattttcgctgggagctgaacaaagttgtgtgaaatctgagaaacgccctctaaaatttgcgacaaagcttttgccttttctttaaaaaaaattctaggcaagtgaagaaaacgaaagttctcaccaagtggaagtgtaagactacccgtatcgcatgccgcatgagctcccctccccttgcatgccggctacagtacctccccgcacgcgcatcgttgctccctacaaggcccycaggcagtggaccgcttctctctcccatgttcctggcgtggcattactcatccattctagcactgtttgttaccgtagccgtggacccgctagtaattgttagtagaagaaaaattgatattttatggttgtaatgtggtatagaagaagaaaatagaggaaccactgagggagattaaaaagtagagaacgtaatgttgatgaagtgacgcaaaaaatgatataggagaagaaatttagaggtaatagctagtccgctacagatagcctaactcgtgacgccaaaaactctaatactgcgatcgagtccacatcgcctgtccaccagtccagagtccaccaccacgtttggccgtttgcaatagactagtgcataaatcgaccggcacgggctcatcaccgctcaagcagtcgccgcaccccctctctgtctctcgcatctagtctagacgttgtactgcagcggcagcgcaccacatctgaccctaccaac

SEQ ID NO: 13821 - DNA, 1500 bp, Zea mays
ggggacgttgctggagactgagaagatatagaggacaaaatcttttagagtgtgctgtaaagtacagagaatattcctttcggggatagaatttaggggacgctgctggggacagcctgaacacatagaggatgagaattttctctaaaatttagggtgcagggtcctttatagaacctgttggaacggtctaaaggagtctttaataaggcgatactattgagctgatcatggagagtgggttcttcatacattgaaatactattgcacaaattaaagtattgtgcaccatagcgccacatcgcacgttgtgatattcttatactagacacgtatttaggaattaggattaaatgagaggtattttaatttccagggatcaatatggaactgatggcgacaaggacaagtaccagtaccatatgtgtatatgtttgtgtgaataccctgtacctcgttcacaataataagcatcagatatttgttttgttgcatttgttcattgctgctttgtttcggcagaaccttcaattcggcttcagaattaaacccgatcgatgaccgaagagaatctgaataaaatttgtgtggcggcatacccagcatcgatcgattccacatcttgtcacgtgattcgtaacatgcatgttccacatttgctgtccctactcagctcgtggcgatgctgacgacatgcactacgccaaagcgaagcaggtccgcgcgtccgcagcaggcgcgctgcgsgacgcccccctcccccttgtcctgtagcatgcatgcgcgccatggccgcagcggctcccatgccaggtgctccacacggaggtccgtttctctctccccctcgatctggcgtgcgtttgactgctctccaaatactgtttacgtgggctcacttccaattgttagtagatgaaaaaattatagtaaatgaaaaatatacatagaaaatgatatttttagttgtagtgaggtataggaaaagtatttaaaaagaccgatgcggaagatgaaaaaataggagatgggatgctgatgatatgacccaaaaaagtgatctagaagaaaaaatttaaggctaagctaactctcataagtgccagagaggccctgcattttccgggccgggccgggccggaccgggccgggaaaagctgaagtagtagtaggatcgagcagcttctgctttcgccggaagtggaatattaaacaaggggaacaattagctaagccagcactgcgacagacacacaacagccgggtgccggtgactcggatccatcaatggctgcacttagcttgctggcatcgtctcgggatgtacatgtacgtacgtacagcggcgcgcggctatataaatggttgggtgacctcggctgcctcctcactgccatagctagctactagctgaggacctcggtcgaggtagtatagttacttattagccattagcagctggaacttgttggaggagagagcttagctttgagagataaa

SEQ ID NO: 13822 - DNA, 84 bp, Zea mays
ggtagagctttcacttttcactttgttatgataactcgtgaaaattcttttgcgttcattttttttacgatttcttctctgtag

SEQ ID NO: 13823 - DNA, 75 bp, Zea mays
agtgagttatttggacctgtatagctagattgagcaagctatgtatgcttatgctattcaaatttgctcattcag

SEQ ID NO: 13824 - DNA, 226 bp, Zea mays
atcagcctctgataagtgatgacgaataatatttcgaaagagcttatctagtccacgtgccaacgagccaatatttaaattttttctatggttattttgtggcacaacaccatctcttcctgtgccttgttgtgttggttgattttattacatgaattgaaatacactgcttatttaagattcttttgggtgaaatatattgttccggtctattttcgttattgag

SEQ ID NO: 13825 - DNA, 1500 bp, Zea mays
cggccgcccagctcgacccctcaagtccagccatgaatggaactggacggtgattgtctgttgccttctgattctagtgaggagtacgctgcccacaaaacaaacgcagtctccgtgagaacaaaaaacgcagctgtgattttccaggacgcgagcgctgcgaacaaaaccatcgatgtttggtagtaatcccactacttgttgtacttaattaggagctgcgaagctttctttcggcaaggaagggcgggagtagcttggaagggagagactacatatagtacaaagcgaagcggcaaccaccgccgatcgagatttcttcaataatcttcagtcccttccccccgcaccccacttgttatatccacgagcgcgagctgcgcgcgatcataagagccacgccgcgtctgattccagctgacggggacctgggacttcggcgaaagactcgaacttttcttgacttgccctgccgcctgcattgcgacgagaggaggtcctgttcttggagcatctgagccgactcgcgggcgtttctcggctcgttgcggtagttcaggtaatcatgatcgccttttcccccggctctcttggattttaagcggtatgcactcggttcagtacataaaatctacgctgtgatgtgatgtagcgcgtggctgcgctgtgatgtagcgcgtggctgcggcctgcggctgcgctgtgtttcagtccatggttcgatgttgttcagttgattgttgggaggggagagagttttgtcttttgcgtgattctatggagtatggaccaattggagtgatcttgggttttgctcttcatttttttctgtggaacgaaacctcattcttcagtttccttccatgcgagtctttaagaaaaagtctcgtttcgatttggaagacaatggggcaggtttcttcataattttacatctcagagagccaagtataatgtcagggggccttatctagcaattggagataatcatttcatggatttgagtgtttttgcttctctatcctactgattggaattcctcctttgtcaagagaaaaaagagaattgttttttttttctctacctgaagatatagatgagcttaccttgatttatgttaaaatggagatatttcagaagtgccttaagcttggtgccataggcaaaatcatagtttcatgattgagacatcaacaaagtggtctagttaaatagttaaataaggaaacctgaacaatcccgcgtactgaattctgacctcttaaaataagaacagataatataaacaaagttagaacggcaggagccactttcagctctactaatggagtagaaattagaccttttcctaccaactatttcccatatttgcattcattctatctttacattcattctatctgtcacattttcctaccaactattccccatatttatagtaagtccaagccattctaatagtccctgtggtcgatgccaccatttgcaggttctggaagc

SEQ ID NO: 13826 - DNA, 1500 bp, Zea mays
aagagaagacaccaccacccttggaatctcaggcagggtcttgtctctactttgacatctgcgggcctgagcctgactcacctactaacgaaggcaagccccggtgcatttgccaccttccttgatgttttaaaatctttctcacttgcttgttgcattaagtaataggagttggttgctaaacaattcctgcattatcttccttgatcttgattaccttccttgataccctgttttacaaaaggtttttactatgcttagtattgccttagcaaaaacaaaaggttttgttttacaaaagatgattggcaaagtgggtgggatgttttcgaaaataaaacttgatggtggatccatcagggccttgatgggttcaacatcggaaaagatgtacctctgccaggtaccaagtttttgggtttaaatgattaagccgagaccgggcgggtgacttgcacgagaagagagtctcggtgtagtgtctctgtctgagtcgattaaggaccgtgtcgatgtaggcttgctgaccgaggaccctttaactggtaacatgcctcgtcatgggtaagccttgcctcgggcagactaaggccagaataagataacacgaaatgggcatggagcggtggcgggagtagcgtgtaccctccgtagcaagaggctggacggtggtgtatctatgctctcggtttgcttgaacctgatctggtcttaagaaccctggtggcgggttgacatatgcaagggttaagtgctacatatgtcatgtgattggagatcctcagatgagtataatcgattcggatcgccgtaccttcgcggttatgaagacttggtcactgccctatacgtagaaaaccagtaaagatgaaggacttgttaagaaactggctagtgcaggacaagtgtttgaactagggtagaaagaactctagatgaaggtaagtttacctaaccggaaaataaaattggatttttaaggatccacttttagtaagcatttctgcaaaacagagtctttgattcttaataagccaaaccttgaatccctctagccagcatacccttgagagtcttttctttagtcgggtaagtcttgctgagtaatttcatactcaggattttattccctgttgttttttaggttttaactttgtgctgttgttgatggtgttaagtgccggtgggctcggcctttttataagtctaagtaactcttctatacttcttattgaggatggtcacttgaggtagcatatatttcaaagttatacttttgcaatcactccgataaaataatgtaaaatttttgtaacttgtaaaatttggtaataagatttccgctgcaaaaatgttggtgtgtgtgatttgtatcacttaatcccgcggttctggttgtaagtgggttatccgatgtccctggggcaatcggacagatcctgttaggttatctggtgcacatgcatagccgtctgaggtctttgagacaaggacaggcgc

SEQ ID NO: 13827 - DNA, 118 bp, Zea mays
cctgccagtaagactaaaaacagattcagagctaatagttgaaacaggtacagttacaacatccaggtacagttagaacatccttagctaaaatggagagaatagggtatgtattctt

SEQ ID NO: 13828 - DNA, 412 bp, Zea mays
aattatttttttcaaattatttatgtaataaattatgaatactcagaaacatttgttacattgttcatctcatatatgagttttaacctagtacaaatatagagggcattcttgtcttactcatacaaaagaatcctattaacaacttaaataatttgggtaaacaaacatgactactctgattatataatccagattatataatcctccaaaaataatccagattatataatccatgggtaaataaaccggccctaaaaaaaggtcgctccgctgaactgccctctgcgcctcataatcgaaaaggaccaaagccacgtttcctcctcaacaaaaaccctcgcaaaaatctgggatctatctagaagcatcactcaacaaaccctaggttgcctgatcggttgatcgctcc

SEQ ID NO: 13829 - DNA, 61 bp, Zea mays
tgcagctgctctgttcatcgactaataataacgtctctctcttagtctctttcactgtttg

SEQ ID NO: 13830 - DNA, 1186 bp, Zea mays
gggggaaaatgacccgccacacatacactgcatcagtgttgctgcatacaaaagtgtatttcgtagaccatttgaataaggctgttggaaacggtgacatctagtgctgtttggtttcgttgccgggacggtaacatcaacagttaatgctgcaatccattaacggaacggaggggaatggatagcgctcgtttatgagtggtttcattactgtataaggccttgttcgtttgtatcggattggtgggtcggaacgattccgagccggattgcttctctaatttatataaactttgattagtcggaacgattccgggtacaatccgatgtaaacgaacaaggcctaaagggtttggatggaaaaactatgaagtcatagttttagttagcagaaatctaattcgttaaaatcccgttcagtaaaacagaagaattataaatttctaaaattatagatatgaaaaaaagacgaataagaaaagtttttttattagacgcatgcaattggcgaaacattttatttaaacaaatgtagaaccaaaatggatggttttgtgcttattaccggttcttcctcccgaattgagacccattgtttatagatctagggataaagtagtgacttcagatattaatgaactttataagagagttatccgtcggaacaacctagaagacttctttggttgataaaaaaatgaaggaaacttttcggtcttgttcgttagctctcaatttatatggattgagtgagattgggtgagtttaaatttcaaataagctaaactttttcttaatttttttctaatctcattcaatctatatgtaataggaataaccaaacaaagctctcataggatttaatcccacaacctagattccttaggaaaaataaaaagaggttaaacctcatgcaaaaattcctttgattggatgcacccatctcaaacaattattttaaactttttaatccccttatttttttctgtggtgtagccctttagttttgaattctgtagagttagaaaatacatgggttctattttcctgaaaaccggtgttccaaagaagccctagaattctagagcttgcaaaaggcaagacgcggtatccaattcccctctcgcgtacataaacgacggagaaaaggacacaacccagcccgccctaaaaccctcccaccatc

SEQ ID NO: 13831 - DNA, 885 bp, Zea mays
ggtagcagcagccgtggatacgcgcgctcgcttgcgcgatttcagcccggtgcctgcgcagcggtcgcggtggattttctatcccgtgctgttgttgcttccgttcggtgtttttctcgtctattaggattcagttggtttcgtcagttttgggagtaggctgcgcgttcaagtggttagtttgcgatttttcaatctgtttctgctcttgcgccgcacgtattccacttccatcacgcgtcgcactgctgtaccctgccgcagtggtgctcgtcgctgtcgcgcatttgaaccgcgtcaaattcaaagtttttttatgcgtctggttgcctaataaaaaaaagcgtcaaatccgaattttcttttccgtgtatgctctgccgcctaatccaagttcgtaagtttcggtgcgggtgaaccgaactccaagcccgcttcctccaacaagaacccccgagatcggaaccccgcaaaagggagctttatttaaaggggtggtggtctttgctctttgtgttctgtcccccacttcactgctgctgctgtttctttttcagctttgggcactgaaggttggcttacttgacaggaaattccccgtttaattgcatattggacatgtcttgtggcgtttgattggagaatttaattcttcccaacgatttccgttcttcggaggcttccatcttggtttcagttctgcaggttgtgtgtttgtggtagggtttcttgtttactgatagcttctgacagtgatagggttgtttctgaggattgatgttctttgcagatctgtgactgagaggggaggaattccagtcagtcgtttatgaatcctggggcctgtgcttactagagggagggcaaggcaagttaggatccgag

SEQ ID NO: 13832 - DNA, 469 bp, Zea mays
atcccctatagtcgatctgcagtacaaagcaaaattacatttcccatctagaggacaacataataacaaaaactacaaggaatgcagatcagtcatgatttgatatattaaaattgttatgaattgcactatattcaatatggggcactaggcccaaatatatacactaattatagagactgagactgtgactgtgtagaataagaactctatatatgagactgaatacaacaaggacacatgcatagacatataacaaggactctatataagagatcgaatacaacaaggacacatgcatagatatctaacctccctcccctcaaactcaaggtggatcaaatacactgagtttagagaggtaaaacctatactcagctctagtctataccttcacgaaggaatcaatcaactaacgctttgaaggcacatatcgaagatcaaacatatcatcttgaacctgtacaca

SEQ ID NO: 13833 - DNA, 1500 bp, Zea mays
ttttgcaaatagtcaaagatatatgaataagattgcgagaagcattttcaagatttgaaattttcaccccctgtttcaaatgcttttcctttgactaaaacaaaactccccctagatgaaattctcctcttagtgtccaagagggtgttcccaaagaagatcaaatatttttagataccaatgtgaaaaatactaaccaattgaaaacataccaatttttaaatatgtcaatttaaaaatttccgaaaggtggtggtgcggtccttttgctttgggctcaatatttttcccctttggcattaatcgccaaaaatggagtcttttagagccccttttcttttctcccccaatggtacaaataactatgagtgaagattataccaatttggagagtggtgcggagtgacggtgaagggtaaataataccgatagagtggagcggaagccttgtcttcgccgaagactccatttccctttcaatctacgaggtagcataggatgacacttgaaaacacattagtcatagacataaaagagatatgatcaaaggtatataaatgaacaatgtgtgcaaagtgtcaatcagagttccgagaatcaagaatgtttagctcattcctaagtttgctaaaggttttctcatctaatggtttggtgaagatatcggctaattgttctttggtgctaacataagtgttgggggccttcgtcctccgaaggtcctcaaaaacatgatttgacaatgttttccaagtgaattatatgaacaggtattttcggattcagaattatggatatggagcacgaccaggacgaaggctgagccagacgaaggtcgaaggcagccgaagctgtacgcagggaagcttcggcgcgatagcacaagggggaaccgaccttaagatgaaaagacttcggggtcctcaatagatttccataaaccgttaacaaatgtaatggacatggatgtaattttacgtgggctgcgtcccgcgtctataaatagatgaacagtactcccgtactgttcacgctgacttggcatttgcttttgcgtcatccttgtacttttgtcttctctcaggaccgaaggtacatttgtaatttgaaatcatttctattttcccatgttaataaaatagaaatgattccatgatgatgcttatattatatctcatgctttatatgagtctttcgttattacctattatatttacgaaggtatgtctcttatgaccttcgtccgaaactcattatttcccgaagggacataatgcttcgaaggacgaaggactttaacacttaacacttttcatgttgccttgttcttaactcttagcatttgagaacaagtcaccaacattggcgcccacctccggtgaactcacttccacttcttgagtttttcggcaccttcggcaagcatcagcttcgtcatgccgccgaagaaggctccagcaccaggggctggcacgctgcagccgctggaccccaatcaag

SEQ ID NO: 13834 - DNA, 454 bp, Zea mays
taaaaattaaactttatatgtttctaatagacaagttagtttggctagatagagccaatttagagagtcgaatgacttgatgatttggatgactaatccgttgaatagttatttagttgttaaattactaaattttagtataaaaagttatttgactagtttcttaaatatagtattagatgttttaactaattttagcagctacataactatttgctcttatttgctccagtacattaaaagcaaggcctaagcctccacttaaatagccacggccacccctctctctcctctccctcgttatttccgggctccctcctgtgtacaccactcccgccccgcctaccattttatccccgcctctcctggcctctgccgccccgtcgcacagaatcgcttggtgcaccctgcgagggcctcctcgaaaccctagcttgcccagcccctccgggcc

SEQ ID NO: 13835 - DNA, 99 bp, Zea mays
cgtgatgcttctgggggaaaatcaaagggacaaggaacctgaaatgttctcattgttactcttgttgatgcggagacagaaagtagcataaatgctacc

SEQ ID NO: 13836 - DNA, 1500 bp, Zea mays
acggcaatggcaaccccagggttactggggtggctgaatggtctcggcttacgcaattgtttgtggcagctgcgtgggctaaatgtaggttgtctcttgttgcactgcaggatggatgggtagcctctgggccgcctctgctagtgtctagcgttgctgactgtggtttattcagggatgcccatgcccatgctagattgataggtgccattctaatggtaggtggcggtaaggtttattaagctgtagtatcagtaggtaacctcatgaatcagggtttaagcacaccttttcctttgtgtgggtgcataaggaatgcacttggcttcgttccctgctagtctttgctcatgtgtcattctaccaagtgggttactgtaacattgcactctatgatggttggtggttgtgcatctttttgcttcccctggttgtctaatacctgcatgtaactgatgaccttcttttatgtatcatatagattacatccttttgttgtacatctcaattctgaaaaaacaatgttttgcattcttagcgctctgtgcacaaggaaaaggaggttttacctgcaactttttttttcgagaaaaaacaaacctttctgaaaggcagtgatcatttagtataaagaaaatttgatttactttcttcagagagaatattccaaacaaacaattttcttactgtctgagccacgaaatttgatcttgatcttactttcacaagccacatgaagccttatcatcgctctgataaaaaaaccaaataggtgattcatagaatgagaaaaagaacctgttgccatttggggaccttgttgtgtactcattatcccccctgctcaggttgaggtttccttgccactgccaccccttggccccttcttatacaaccatctccattgaaaaagattttgcactacatttgggcttcgtatgacaaaaaaggaaaataaaactaaacagcagaaacatagtataattatagrtaaaaggttctggcaagtttgagtggaagagacctttgtatatttggacatatttcactagtaaatagttttctaaaatcttcatgaatggtggccaataaacttgataagatctcaacatggcaggttccttcaaaatgagaggaaaactggaaacatcacaaatattttttagcgagtggcctataaattataatgttgctttcatttctttgatattcaaaacttcctaagagtattctgctagagctctgatggtgtcttttgcctctgtcagattttccaggagttttcttccctttttatggcactgtgcgtttgagaaggtcttcaattgtgctgtctgggccacggaacgacaatgtcacagcttggattagccgcagctgcctcaaaggccttgccactactccctaatcgccagagaagttcagctgggactacattctcatcatcttcattatcgaggcccttaaacagaaggaaaagccgtactcgttcactccgtg

SEQ ID NO: 13837 - DNA, 793 bp, Zea mays
ttaacggtgaatttggtgagctgtgggagcatcacatgaatacagagaggttctgatttagttgaacaaagtggagttgatgccggggtggtgctgtgcgatggatgatcgcgtaagtagcaagggtagctgccgtgcttgtgtatccgacaatcatcggtgatctttactagttgcttttccttttaaaaataagagtgtatgataagggagttgatgcagaattcagatatttgcatgagttgggacgataaactagaatcgagagaattttgcagggatgctttttttccctcccatttttgagctgagtccagttgaacaccgaccggattaagtggcaattaatgaatggtcctgtgcgctggaacaatctacgtgggtttggtaaaacaaagtaaaaaatgtcatttttatggtctatcttcccagtgctgccataacattaggatgatggtcacgtccaaaaaaataaacaaaaggttgattacatctaatatgggatgaatgatcattacgcaagaaatatggcagcctgatcatcaggcaagaagcacagcaaactcctgctccagaatggccagaatccttgtttcatttgacagaatgctattttttttcccttctatgcaggcatcaagaacaagctttgccccggccctttgcctcccctcactggccgcatggatatttgacgagaccgacgtgccgaacaagaccggcatccaacgcggagagaagatctcgccactaccacaagctgtctacggctgcgcccggcgccgtgctgaag

SEQ ID NO: 13838 - DNA, 180 bp, Zea mays
tcggcacccctggcatgaagggtcgtccaaaccgctataaatagaggcttttcctcccacaaatgccccaataagcagctcgatcagcgcaaatcgtcgagtgcattagccttgctgcgcatcgtctgtgtgcgaagaaaacaaaacacttgacacctccaactccaactccaaccaacc

SEQ ID NO: 13839 - DNA, 1001 bp, Zea mays
tagaactaggctggaccttccaagcccatgagctcggtagatacggaaaagtgagctggtaagcatggtttaataaaaaagcgggtttggtgggcttagcggtaaacgggttgaactgggctagcaccttaggttagttttctgttcgagtctgacctacttattcgtgtaataccggatcaagctcgtgtcgggctaaaaaacgtgcttagcttttgggttttcgggcctcttgtctcgggaaaagccaaatttgctgtcaagctcatgtgctcttccgatgtgccacatttagcgcgtagcagacaataattcatagaataggaggaagagtcggctgttatgtacagacaaccccatgtacatctcatcatttgaggaatcaatcaatcttagtttgactatatttataaacaatcataaagtcctctttagtaggactttttctctgccagctccagctttggctctggctcctctaagaaaacagtttactctttattttcagaaagagctatagaaaaagtaccgtgtttggttagaaatatagcttctcctgcaccttcttctacgatgtagtgctgacgaagagaaaaatatgtgagagaagctggtagaaactactttttctggctccctgttgattttttttggaggaactcctctctattttctagaaagtgtccatcaaaaagcttcctctttggtagattttaaggagctgttggaggagctctacgagggctcacatttgaaaaaaaaaaccattcttacgtccgctgctctaaccatccacccagattttaattgtgcgctggtgttgaggtaccatgtctaacaacagagaccgtcacaatattagactaattgaaggaagtatgcacagatgctaacgataaaagtccacatcgtcgtctcaatctcatatcctggtgatgattattatctatctatccaccatcgatcacgcaagcaagccaagtgctcactgttgatcaata

SEQ ID NO: 13840 - DNA, 1021 bp, Zea mays
gacgttgctggagaccaccaaaacttttggacgagcgagtctggaactttgttctattttatcttaaaaaaatacttcacacccatttcgagctccatttgtttcggtagataaaaacaagagaaacactgtagcagagagcagccaaaagaaaaaccctgacaggaaagaaagccgaagtcctacgagccctagagccgaacacctacacgccatagagcagcagtgcatggggtcagtcctgtctggctcctccaactctccagccgcacgcgcatcgacacgcgtcgcctacttcctgacatgtgctctgatcgcctagtgccctccccctctcctttctctttctctctctctccctctccctctccgactcacccgcgtacggcgacctttattgcatcgcatgctgcaggtcccgcccccgcccccgcggccccgccccctccacggacaacggctccacctccggtcctcctccccgcgccagattattgcggtctggacgtacgccagggcgaggtcgaggagactcgagggggcgcgcgctggtacgggcgaactggcggcacatcaatcggctatcacgcgtctatcagggcgctatgccccgtcccctcgccctcgcgggcgcggccgtcgccgtccccaccaccatgcacctcgcaaaaagcaacagctcctggtgctgccccggtgggcgagtgattgattggtcgctacctgatggatcacggcgtcactgccaagtagatagatcgataattacttgagtgtgtgagagagagagagtgggcgcgcgcgaggaagaagttaggttagaaggactctccaaaagcgccgcttgagtaaaaaagatctcgccccaaggggtacgacgactacgatcacacaatataagcatctctctgctgctcaaagcaacccaggccggactcccgagggagcttttttagagcaagagaggacggagaggtagagagagaagggggacggaacaagcagctagctagcagggaag

SEQ ID NO: 13841 - DNA, 727 bp, Zea mays
agctttgtgataacattttgtgcccttccccttcttgaggacacaccttgctcaagctaccaagacgcacatcaaatttatcatcaagaaggatgctgctggcttgcacatccctgtagtagagaaccaacaaatttagtcaacagcaaaccttcacattgcatctaatttactgcccatggaaggaaacatctatgcagccaaaacccttcgtgttgacataaaaaaatgacaaaacgacaaaacaatcagaatcgattgtgatctactattctactacgtgcctcaattgataacaacacaaggaaaaaaacttcccagtgaaatcagggtgacaaagaacatcctgttattctgtatggcaaaataggtgaatgtttaaatgatataggccaggagaaacatctcagcaaaaatattaaatgaaataacagcagcgttcacattgaatttccaatacccagataatgcatggaacatgtcgcatcaagcacgggatactaaatttctgagtcagcaattgctggcacacattagcgtatgttcaacgtattcctagtctatggggaaagcttattgcagtagctgctgaagcctacattaccacaacgaaaaaattcaattatcagagcacccacagtgactgacaactactaaaccccatgtaatgataaagattgaatttctacgagaaatctaaaactctgttgtggacagatggctccat

SEQ ID NO: 13842 - DNA, 378 bp, Zea mays
ccaaggttcaatcctcccttgccttaggtgatcattgcctaaaagcttgggtaatactttggtccttggcattacttaactcactcatgcttccaaggtcataagtactccctctcctccaagttttaaccacatgtgataataggtatatgtgccattaggaagccaacaccttggtaacacctggggtgttacagctttagcccatatagcgccttggacaacctgtaagcatgattaggatatctagggtcttcaaacccggttggttgctcaacatatacaagttcatttatgaagccatttaaaaatgcactttttacatctatttgataaagctttatgtcataggaagatgcatatgcaagtaggatacgg

SEQ ID NO: 13843 - DNA, 1217 bp, Zea mays
gtcgaactaatggttcaatgttttaggagatgctcatgtaatttttttattcagattgctgcaaaatatcggttatgtgttctgaagatgcttcactatattgatactaatggtattctccagttctaaagatattcatatatatttttttgattcagactattgccttttgtttattatttcagtgtcttgttcttaattgagagctgctggctgtacgagaggacaaaatatgccttctctgtaggagacgacatagccctcataaataaaacttgtgaacccgaatgcaattgcaaatacagttgtatgatacgctgcctctgtactatggcaaacctctagccttttacatttttgcaaataaagaaggatgtctgcatgataaagaaggaaacgcttgtctgtaccatggatggaaacagcgatagcgagctccgcagatgaaaagcgcagccagacggagatttggttgggaacgagacgttttacttgttaacggagttgtgtcccatgctaacgcctgcaaaggacgaagatcatgggccccgcgcaatctgcggcagcggcgggaggctaatccacatccagccatcgactcctccatcgtgcggctgtggccgtttatagcacaacaaaccagtgctatgcgtagcaaactagcaattctctatatatatataacatattcaataattgttatgtaaatgatatatatatagttttattttgctaaaacgtgatagatcatttaacttgtgacgtggctgtttaataaatcgaactggtttattaactaatcgagctataataacaggtaaggtcgagaaaaattcaaacgacccgattcattcaagtcgaggagagcattttgtactgccctacccctaccgtcgttcccacgcatcgtgctgtgtgccgcctgctcccatgctctgccaacaccacatccggttatgataaattgatacagatccatgataataatagcttttgcccatgtctggtggtgacgtcgtgtgccccagcgcggcgtctagtcatcagatcattatccgcaccgacttgcgtgcacgagcttcgcggcgagggcagcaccggggctgggaatgggaagacactgcagcccagctccagcagcactacagcagtagcgccaccgaacctgaaaactccgaccccccacgaaatcgcggaacctacccacgagccgagcc

SEQ ID NO: 13844 - DNA, 1011 bp, Zea mays
acagtctctatttttgagtagtaagcacaatgctacagtggtctctttggctaaattagcgcatcgatttccattgcaaccgtggtgtagggaaaaatgacaagtgtcttacaattagaatggtattaacataggcacaacaggtttaatccgtattaacatagctctgcgaaaatctgttgtttcgtttgatgattcacttgcattatggtgatttttctagcaaagtactctctttttctaggcatattgtggacggatagtgtcattggaagaatatttttgctagttctagctgtcaaataaacaagcactgaacaaacaaataagaataacatacatcagaatatcagataaacaagagaagacaagatacctgattacgttgttgttcatccaagtttggaggagctgcgcttgtcctagcatgaaattgttgtacaaatttttatatttaatatatgtcatgtaagtagaaagcaaaaggtaatttcttctatatagcttcatgccccaagctggaggtaaaaagggataacaaaatcatatcggcaacccattaatatttatatactaccaaattgaaagttaaacccttttaatggtttccctgaaaagaaataaacaagaagaaaaattaggtggttaaccatgcgtgagtgcaggctggaaactggtggtgccgtgctgcccaacctctggtgtccttcgtggccattgctggccttgttagatagattctatgattcatgtttatcttccttgtatgcttatccccttgtaactcggaacaaaccagtagagtcggccaaggaatagattagattggtttatttgttagcccttgtcttggaccgaagatatctcatggtttgttacgttaatgtaaatctgaagcgcgctttgtcgctataagtaacacgcaggcagccacaccaaaggtaagctgcttcaccccaatcttccgcgcctctgattttctatatggtaccagagccaagaaataagatc

SEQ ID NO: 13845 - DNA, 125 bp, Zea mays
acctgcagttgcttcaacctctctggctatataatacaaggcaaagcttagaagggagaacaccattacaacagcttgcatttgctctttccttctcttccacctccagtagcttcattccaagg

SEQ ID NO: 13846 - DNA, 1124 bp, Zea mays
cttttgtttttccctctgttttttcttgcttcaatttttggaaggagcatcagtttatttactacaattgtttgtggtttgatgctattctcaattacttcatcgatagaaaagttacagtaatggtgaatttaacacatggcgctatttttgcagagacttagtgatactccttatcatcttgatataaattcatatatgcattttttttgtgacgtacaaagctcctgctggttagaaaatagaaacaaatgtcattttggttgaggttatctccttctcttatgtgaaccacaaaatatttcatgttgctaacatgtatttgctatgaatgtattcatcattttggattactaaaatgttcatataaacaaaagcagtaatttagatagttgttgatataaccaaagctgccaataatatggattacgtctacaaatacctctagaaattctacgaatcaaccagttatcctacgtacttctctgtctcgcctcccttcgggcccacaccatcttcgtccccaacctccctccccacgccacctcctcgtgtcctcccactgaaattatgtattggatgttgccagagaatttataagattgagatcgataatatgtgatatktggtttatgtaatcgttgtgcactaatattttatcgaatattttgtttgtcgttgcaacgcacgggcactttgactagtatatcacaaaattcaggttttgtaaaccaaagagacataaccgaggattatataaaagaggtcgtgtgtaaagtttctaaaactctaaataaactacagttttgataaaccgtggttttgcaaaactacatagtatatttcagaaacccaaaaaatttgcaaaaccataatatacttattcaatactctaaaaatatttcgcaaccaatccgagcctaaatattggtaattaacattcctcaaaatagttatggcccaacctgacagaaacagattcaccagccatttccatttggtccgaatcacataggtccaaggcccagtattgtatttttcccctaaaaccctaaaccgcacaaaaccgcctacgccattccgctgtccgcaatccactccctcctcccacgaaactcttggcc

SEQ ID NO: 13847 - DNA, 882 bp, Zea mays
ctgtcacgcgtcctatgtataatggggtgtatatatttgacagacccaaaatatcacatgtgtaatgggctggtttgtttccacaggcagaaagacgaacaaacaaaccagcacgtcgtatggcgaatttgcagcgagtcagacgccctcacctgccggccggcgaacccgtcgtggtgaggctcacgttgttgcgttcccgggcctcgggccaccaccaccgcctgccgccgcgcggaaacgcacccgcggagcccgccgcccgcgcgcgccccgagcagaaacgcaggtcgccaacttgccttgccgtgccgttccacgccatttatttactgctcctccccgttgattccatgtcgcgcctctcaagaatatctctacctctttttcatttttttttatccaggaaaaaaaattaccgcttgatttgacgcgattaaactggtaatccttcactgctcccgattacaggcatgtcggtacaaataaaccaggaaatattcccgtcgaaataaaaccaccactaggaaatactcctactcctcgtgctgctgctagcctagcctagcctgctactcgaacttctcgtctcgtctcctcctcgctcaggcaggggaacccaacggaactcctcctccccagcagacagccgagagtacataggagacgagaagatcccatccactaccgcccggtcgcggtcctccgccctccgccctccccgccgctcgttcggtgcaggtgagcagctcggtcggtcgcttggattcgggcgcccccgtcccgtgctcagatccgggtgtgctttgaattccgctctgacctcccagggtgctgctccgcttgctccgtcccgtgcaggtcgccctcgcgtggatcgga

SEQ ID NO: 13848 - DNA, 166 bp, Zea mays
  unsure (1)..(166): unsure at all n locations
ctctctctctctctctctctctttctctctctctctcnccggtaagaacaaaagctagacgacgaatcgaacatgaattgcaactcatcagcatgcagcagctagcaccccgtctgttctgttctgttctgttctgtccgctagtgtcgtcttctggtggtgagcg

SEQ ID NO: 13849 - DNA, 160 bp, Zea mays
tgtaagtgttgttgtcttytaatgttattgctctactatgatgtttggtagaaactttcttcttactttgccctttcacaagttattaatgaacattccgtgtcgttactgaatcagttaaacggtatatgagctagtagttattctcattgctgttttt

SEQ ID NO: 13850 - DNA, 163 bp, Zea mays
agctttactacccaaggatatcgcattagaagctaatgctgtacaggtttgtcttgataacctccatacactgtagataccgtgatcgggtgagttctctgtaagtagcagttttgcagcatctcttagatagtacagtgtgatagatcctgaaggttacttc

SEQ ID NO: 13851 - DNA, 854 bp, Zea mays
cctgggacccggtataggttctttgccgagtgtaatgtctctgacactcggcaaagacattacactcggcaaagaggcacgctttgccgagtgccatacatagcacttgataaagaacctgacatgggaccctccctggtgggttctttgccgagtgttccaggtggcacttgacaaagaagttacctttgtcgagcgtttgccgggcagacactcgacaaagacgccgtctccgtcaccccgtcgacgtaacggctgcttttctttgccgagtgccacatggcactcggcaaacctatttgccgagtgcccgagaaaaagtactcggcaaataaagctttgccgatgcactgtttgccgagccttctttgccgagtgcgacactcggcaaagcctttgccgagtgtttttaaagcattcggcaaagcactcgtttccggtagtgaggggaagtactagcggtggacattctactttttcataaagtagacggacgccatagttatctagctcacataaatcctgagcctcacaatgtgccagctgctttcactggatccctttctctgcatcagagatcagaatcgacggagagtatcgaatttattgtatgtagatgtgcgcatcagtcatcaaaccgcaggcaacatgcttgcgtatggtccctacttagtgcctatcatgcatgcatttgcctaacttgttaatctttgttagatggtcgtcgtttcgtacctatcaagcgggactaatgtatgctgacgcaaaaggaggccgcgcagcgcattatataaaaacccatgtcccaggagttaggagtagccccaacagacgaccactgtatgcttgtggaa

SEQ ID NO: 13852 - DNA, 187 bp, Zea mays
cccatatctgtacaccctgtcattgccggctccgtcggccgtcttcccgaggatgctgcggctgcgctggcgtgccgtcctccccccactcccactccctccgctgcctggcttgcttcgccgcctgcctccgcaccggcgcgccctctcgtcctcttccggctctatcccgcttccaccgccggtg

SEQ ID NO: 13853 - DNA, 73 bp, Zea mays
actccactgctctgcctccataataagcacagaagcgccccaataatcagcagcgcaggagcgagcgatcgct

SEQ ID NO: 13854 - DNA, 232 bp, Zea mays
cgtaatttaacaatgtcttctaagtatggcttatgcatagttaccttcggattacacaatgagaagggtgcgatcgtgacgaaggttgccgatacttcgaagctatgcacaaaggaaccaacttaaaaaggaaaagactatccagccctcatagatttttctataagccaataataaatgtaaagggactggatgtaatttctcacaggctgcgtcctgtgcctataaatag

SEQ ID NO: 13855 - DNA, 64 bp, Zea mays
cgcgggctcgtgggctccggcggtggctagattcagggtgcgggagtcggcgtcgtcgtccgag

SEQ ID NO: 13856 - DNA, 147 bp, Zea mays
gacgcggccggccgctcccaaactttgagtagtgccgctctccgtcgtcctcttcgatctccatcatcgcgccacgtacgtacggtggtcacatccctgtcgaccgcgcgcgttgggagcgcatccggccgtgtgcattagccgccc

SEQ ID NO: 13857 - DNA, 1500 bp, Zea mays
gttacgcagctcccttgcatatttgagtaaaactgtcttattctgaactttgaagatgttgagaaatatgaatccgtactaaacatataagtacatgaacttgcacttaacaccatcaaactttcaattgaagtttcatttgcattgaacttcaattatttattgtatggtagcaatgttgtaattagagtttgtgcagagaatagtgaaacacctcacaccccttgggttgggtggctttcgtatatgtagtcacattggacttcagttataattagacccctagatatacatatctaacacccctgcataagctgcatctttttaggtcaggaacatgaaacgtggtagacaaaagagtgccctgtccagcaacaggcaacggggaaccatcagttgtatcaataatgagagaatgagatggagcccgcatcgaagaaagatgggtggaataaggagtcatatgaaaagaaacaccagaatcaagaatccaggcatgtccacctgtcaaagctaaagattgtgctactgaaccagcgactcccggcggtgcagagggagcaaggcgatgaaggagcatgagcatctcctgggtagctggacctccagtagtaggattactagtctttgaagaacgataagcaacccttgattcttcttcctataacagaaagactccacatgtccatcctgtccacaatgattgcaatgaagaccactaccccctccacgtgtagaaataaaagggtgctaacgacggtgttgggggccttcggcttccgaaggtcctcaaaaacatgatttaacaatgtttctggagtaaagtacattaacaggtatcttcggactcggatcagagccacggtatgaagaagcacaaagaacacgaaggttggcgcagagccgaagctgtgtgtagaagagcttcggaatagcggcggaaaaggaaaccgacttaaagatgaaaaaccagattagacctcgaagaattatcatagagttattgataaatgtaaagggcattaatgtaattttgcgtgggctgcgacccatgcctataaataggtgaacagtatccccgtactgttcacgctgatttggcattggcttttgcatcacacttgtacttttaccttctcacgagctgaaggtacatttgtaatttgatatcatttctatttttctatcataataaaatggaaatgagtcgacaataatacacaactgtttatgttatctttatgtttcatatgtttccttcttcattattatattttatggtgatgaaggtatgtccttcataaccttcgtccaaaaatcattatatccttggggaaataatgcttcgaaggacgaaggatattaacatttaacattttgtgttgccttgttcttgattcatagcatttgagaacaagtccccaacattggcgcccacctccggtgaactcacttccattttttgagtcttgaacactctcggcaagcatcaccttcgtc

SEQ ID NO: 13858 - DNA, 531 bp, Zea mays
aagaaacgttgcattctctctctctctgaagcaatcaacatatctactggacactcgcaacgctagctatattaaccgcgatattagaaaactggacaaggtagcaaataaatttagcagaaggtcggatctaataactaaaccccttgcctatcaatttatctatgcaacggcaaccggtctggcaaacaagagcagtcgaccgagatgactcggtggtacatgttacgtcatatatttccgagtgtttaattttcagctctctacactttggcccatagcgcgcgcgaaggagacggataaacgcacacgcgcgcgcgtagctaagctagctagtccatatgtttgcgtcgcggaccaccactccacaatacacaaagcggctgcggatgtgagtactataaagaaagcgatgaggcgccaggccggtagccaaggatcgagtcgtttaattttctactaggagctagcagcgagcgggttatttgcaacgacggcatcgtcttggcgttggcgggcgtgtttggcacc

SEQ ID NO: 13859 - DNA, 355 bp, Zea mays
tttattaagcattggcttattgggcaccttaaagaaatgggcttgcatgctagccatactgagatgaattcaatagtcttgccaaccaatattttgctccatttaggaagcgacagataaagaaggaaccaaaggagttgaattcttatactttctaaagcttacatctgaaaattctaatttcaacgattcacaacttaatattgagactacttggagtgttccaaccagcaatgctgatgatcttgaactgcattttgggaagttcgagcttggcgagcctgtatcttttgattccctagtggacagtggttccagtgatggtttcaagctgactcggtcttctttaggctgg

SEQ ID NO: 13860 - DNA, 579 bp, Zea mays
ctggcaaacagcaggtcactctcctttccaaacaggaggtaccagcccaagtgaagtgccccaacgaacgaaggaagtcaaacaccacaccaccagactagcggcagtctcaaaggcagcgcattcgagccacaaaagacccttccgacgctgagatcatccgtaaccgacacactccccactcatctcgtcctcatcctccgctccccacccacccccacccccacccccaccccacagatctcgccgcggccaccgcttcctctatggccgcgccagcccgccgccttctcctgctcgtcgtcaccgtagctggagccctggcgctccccgtggcggcccagatcaaggaggagtccttcaaggaggacccgcgctcgtccatcatgttcgaaaaattcggcttctccgagtccggcgcggtgcggatcatcgtctcgggcgcctccgtctcctcccccgtcgcgcgggcggaccccaggcagctcgggttcttcctcctctctgacgagtccctcctccacgccatcgacgaggcgcaggaggggcccacgcgggagaagcgcaccacggcgacca

SEQ ID NO: 13861 - DNA, 1500 bp, Zea mays
acataattaaggaaaaattacataattcaaataaagtaaataaaatgtaataaagttttaaaaataaatgtacatatttcgtaaaaacaatacaatactacttatcatcattatctttctcattcatctaattttaattgcttgatcaattttttacgggtataatctgtagttctttttatatcatcatctaagttggcagtgaattaatctagcaagttggtgaagtggtcgttgttggagcgaagacgaagacgccacccttcgctcgatgccttcgccagcctcgctgcaccaacggagacaagacgactgacagacttcacccttcgtcccacgcgtcgcaggacgaaggcctatgacgaggtcgtcccatctcgcggtctcgtccaacggggagacccacttgtgatccagcccattgtaacaggccctgcgtggccgccgcgcattacgggcctaatttgtaaaggtttccctataattacagtctgtaaccctgctttatgggaatattccggggataacctaggcgcctgagggcacatgcgtccttaactcaagatgctgggcactcaggcacctataaatacccccacacagtgcccttgagaggctggattaacagagctattgccatctcgagttgagaccttgtttacactgtttttgctcccccgttggattaacttgcccaggagagcaagttccaacatttggcgcccactgttcgtgctacgaacaaaccacccgcgatggcacccaagagagctagctcgaaggcagccccaaccattgacgaagcagcgaaggcggcgttgctagccgagaaaaagggcaaggcccttgcagacaccacccatcaagaagcctgcgaagacgatgccgtcagcaagagacagcgcaacgaccaaccaactcccgagggcagcctccgcacctgcagctctagaggacaaccacaggaaccccccaggcttcgctccgctagagggcgaggacgccacagaggacggcgaagtcatcggtgtttcagtagaagaacagctacaactgcgggccctgcgcatcaagaaacgcaacctccagaagcagaaagaaatcctcgaggccaagcgccaacgtgtttccacgtaggccaaggtgcgccggatgatacgagacgaggagcagagggctcaggaactagagcaagagattgcgctcatgcagcgcgaaggccaacatgatctacagcacggcccgcccctccaacagcgcacgccagtcggagacctattcattcctcagcgtagacccttcatcccgcacgccacagcattccaaggcatcaactaccttgatgaacggagccccctggcgccgcaactgcaagtgtcaccatggcccgccaacttcagggcagggacctaccccaagtacaacggcagcactgagccagcacagtacatcatgagctaccaagtcgccatagcatcatccggaggggacgatgccacg

SEQ ID NO: 13862 - DNA, 160 bp, Zea mays
aaagagatgcagcgactcacaagagtctccatgccacgtcactccctgtgatcttgatcatacctcaaatgcccggacacagctcatagtgttgtatgtaccgaagggatgtgagatcattttgtccgtcttctagaattcagattttagtattttactg

SEQ ID NO: 13863 - DNA, 874 bp, Zea mays
tttgttagctagcaaattatactagtatatttttagctaactaagacggtgttttctagctaactaacaaatagttagctaactagtagctaatttactaaaaataactaatagctgaactattaaatatgatactattagataggatgtttggatgtatctaactaattttatctactaactattatctctagtacattcaaacacctcctaactattagatttaatattagtgaaattagctatctattccattcaaatacccctaaaactaaaccagaattatctctccaaagattacgtgagaaatagacgtgccgattcgggactggaccgatgaagccagcgtgctcacggggaaatgcaagaccgagcaaagcacggcgacgtgccgaccaggcgacaatcattccttgtcatccctacactacacggccacgggcgcatggaatatgaaagactgtttacatattcattgcgttcgtcatcatgaatccatggcggtcgcgtcatcatctccgccgcgcctgcgccttccaacccacaccactcttcccctccccgtccctttcaccaccaaggttcctccatcctccgcggtggctgaccaattccaccattcggctccacgtttattttctaaataactgctactccggattccatacttcgaattgatcccgtcctcacgcggcagcacctatcccccgcgggtcgcatcgagtccaccaccgctggcgtcggttccttccgcgcaattccaccggcaaaagcagagtatactaccgactagagaagagtttggagtttggacccgctgcaccccgaagtcccgaaccctacgctgggggaagctctcacgtcgcgcccgccc

SEQ ID NO: 13864 - DNA, 967 bp, Zea mays
taacctgtaagacaaatataatataatgatatataggtccttgttcctgtcaatatttttaaaagttgtttactgtggtatgaaataaatccatgagaggtttgagctgtgtatgttgtctgggttttatagttactcttgcactagttttctgtccatgatatttttcatcatattttttcgatgagatcaatcaagagcagaaaaatgaacagatatctgagtgctacattagttcatggtctttttcagttgtgtcagttgttttatgttggaaaactgactcctatttagaattctatattagtatgtaccttttgttatgccacatgaacctatggcaacagcctaattccatagcccacattaccttcaaggcaaaacctttccacaataatagtcccttgaaaacttttgccacgacaatacttcactgctacttggcccccctttggaatgcaggaattgtataggattcagttgtcacatgaaaaacataggaaagaggaagacatctcgcatttcaatggggggctataagttcaatttttattatatatatccgattaattgaatatttagttcattacaggtccaagaaagtgcttgaacttggatctggttatggattggctggacttgttattgcagccagtacaaatgctgacgaggttgttatttctgatggcaacccacaagtagctgagtgtatccttcttaatataatgtatgcacaatggagaatggagtttttgccaatattgtgaacagatcaatcattccaaaacttagcccgttttgttttgttttgttttgtacttttcttatttcaaaaaaacatttgttggcctttgtaaaccattaacccgcagacattcagaagaacatatccatcaatgcagagacttttggtgagaccaaggttaaatctttgatactgcattgggacaaagagcaagcttcagaa

SEQ ID NO: 13865 - DNA, 503 bp, Zea mays
tctggaagataaaagtttgagcaagtcactgttgccaccaaatcgctgtgagacctatcctaacagaaagactaaaaatgcttataggaaagacaaaaatcaagagagcctgaaagggaatagggaaagtgctggatttcctcctaggaaagatatttcagatttatctaacaaaaagagtgacaagcaagagttaaagcccaaccattaaagtgcaaacaggaaagaggaagagaggaacagaaaggaggttgttatcgaagaagcaaagttgccaggaccctggaccattctctgcgtatcaccaagaaattgcatcttgcaatgaatccagaaaatccacccacagaaggattgaaaatgacccttctaccgaggtgaagcttaaagttggtgatgtgagattggcaaacattgatgaaaacatcaacaagcccagtgggactgagagagaaggaatagaatttttttgtggtcctgatgatgggacaaaagagcaggac

SEQ ID NO: 13866 - DNA, 342 bp, Zea mays
ctctatcatatgaaggggtgtataggttccttatatagagatgtgagaccccctcaggagcaaagccggtatttgcccacataacccgggttacttaacagaaacaagcgttcagtctcggaacgtgagcaacaaacagcgttcactgttgagggccatgtacgagggcaaagactccctcttggcccattgacggcccaaagcccagtgaccagcgcgcgtccgtcggccgatataaagcgctagggttttacctatcgtttgccccacgccgtcactcctctcaacccgaccacgccgcgcctccgcttcgaaccctagccgagcggggtaaggagggaa

SEQ ID NO: 13867 - DNA, 1500 bp, Zea mays
tgctcctcttaagctccgggccggggccccgtgctttggatctccttggttgtggctccaaaaccagcgtcaagaacagttgaaggtgtcggatcatcttcagtcttcacagatactatatacatcaatacatgcatggaatcctacggtgtgcgtgctcgccgtacgtgtgtgatgttaccgccggaggaggaggaggaggaggaggaagaaggagaagaaagagacacgaatgcatggaatgaagaagctagccgatcgagcaggtactgtcgcgctcgcgcatctgcaggtacagacgtacagtataccaaaagagggacgggcgccgggcggatctgaaggccgcgccgcatgcacgcacgcacgacacggcatatcggtcgcagagggcgccagagatccccctgtccttcttggcgccggccggatccgggccctggcatgcagccatggccaggggccagctgctctgcgtgcgtctgcgtgctgagagaccggccggcatcagctgcatgcgtgtgagctcggcttcgcctgctcatcccatcgatcagccatgcatgcatggatccgattccgatcagcaacatgaatgcacgtcacttcctctctctctctctggctctcaatctctcacgctctgtctttctctcccctacgtactggtcgaccggttcaacttggcagcagacgcatgcagtgggcgcagagatctcgagtccttgacctcttctcgccctgtgcaagattccatcgcccatctaatctatccttccgttgcaatgcgcgtaatgccatacccatacgttcgtgtagtagctagtcatctgatgatgctgcatccaagacattcttttggatatctcctactagctcgatcacgaatgaacaaaaactacaagaatatatcttaaccctctctcgtctgtatcgctatagatagcttctgcagcaagacgcataaaatatatacggacttgactgtgcatgcatgcatacagctgatggatggtatcatatgcatgcgatgactgggccggcgggggacacatgtgctagtgtgcttattctatgcgagatgctctcgctctctccttccggcgcggcgcggctcgtccttgaccaaatcagcccttggtcgtcgtcgtcgtcgccgctatttgttttttaagtgttgtgtgcttatgttagttaacactcgccactctacaagcttagctacatcgatctaggctaatctgggtacagttaacaaacctcatcagctcgatcgctcacacactcccggcccactgccggaagccggctataaatagcggcccattgcaatgatatgggggaaccaagcgagcaataatacaagctagcaccaagtagtagttgctggctctccaacagcagcagcagcaggcagtagaagctgcagagacaagatagatcgaggaagaaggccgcatttcgagctagcttagctatagagagcgggcgcagctagca

SEQ ID NO: 13868 - DNA, 189 bp, Zea mays
tgtctatctcggtgcagccataacactcaccatttcatttatgtatgcaagtaaggctcttttcagcagcttacctatccttgtacccatattcaaactgcgctatgcaaacagtacggtctacagtgcgaaatagtgttttgagtgaccatatgtgaactgctggacacatgagctgaaggcctcgtc

SEQ ID NO: 13869 - DNA, 1298 bp, Zea mays
tcttgttaatgaatgagtagtggagaggaagagtaaaaaaggacagacctagcgttgtgggctcccaatttactatgagtgggaaaatattttgtggaaaacatggtagcttatgttgaatatataactaaaaattttgcacgccataactttcatgttttttgaagatgcaacagtatcgggttgtgaatatgaaatcgtaattagttgatgactttttgttatcaaagataaatattgtgtagataattcctaattgtgcactgacgacgaataggtaacgattttgaaagaaaaatctacaaaccaactttattatttattaaaaaatatataaaatcatctttaaaaataactaatggccttaattttccaattttgacggttcgagaatgtctgttattcgattttgtaggttacatttgaaaacgggactaacaaataacatggaggtttacctaaatatttttttaatatatctaatgatactaatttaatgttataagtatagttattctttctagtataaacttgatctaacgatttgccacaatttgcttagataaaatttaaatcctagtcttattatctttctcgttcgatgtggcatatatctattaaactaattcgattttatgcaaaatatatttatatactattatgaacaagatgtcggagatatttatgtgctacatttttaatatagatgagtgagacgaagagtgtcatgtaagttatggattagaaacaaattctactaatgtataaaattatttctcattctccacgccatgaatttgagatagacttatatataaactctggaaagtggtggaatgttaaattccaaactaaataagttattttattgagtgaattctaattcctctgaaatgaagggatccaaacgccccgttatgttttttgtttgcttataggttggaatagcgattgccttgtagagcgcacggcccagttgggcccaatactcgacacgactcattgaccggcccattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgaca

SEQ ID NO: 13870 - DNA, 785 bp, Zea mays
ctgagagggagtcgtgagtgctaacgtaacgaagtggactcgtcatttcgtgccatttctagtgacatacttgcagcatctgcaatctcccagtggttgcgtgtgtaagcctgtaaggtccggggcaacggaccggaccaactcgacacccgactgaccgagacctaatacttgggcaatagctcgcgtccagtccagacacacacgggctccccccaccaagcccgtcgcactcagtggccacccaccaccagcccacctccgggcgcaaccgcgtctggtgcggtgccgtgcgcccgtcgtccggcggcaaccagactacccagagccccgtcgagcagacgggccggcgccgggtcaatgtcgagtgtcgtattcccaggcaggcggccatgcgacgaccggctgcgcgcgggccaagctgccagcgccggcggcagaaggttggccggcccatccaagggacagggaggcgtcgtcgcggagtcagctcggcccgccaacaacctaccccggtgccatgccagtctctgatctgaccccaacaacctccccctcccacccgtggccacgctatttattaagcccgccctcccccgcaccgttctcctcaggacgaagagcctacctttccccagctcttcgtctacagcactgccacattagtagttagttaccagcagtactactcttgtgtagtagcttttaatttcccccagctagctagctagtttctacttccgtccgcgcgcgctcatctgcgcacgcacgtgtccccgtccgca

SEQ ID NO: 13871 - DNA, 247 bp, Zea mays
aattcaaggtgttacagtttcctttgtagtagtttggtatattcagtcgacactagactaaatattactgtgttatgcagtttcagtcgtcccgtggggtttcattgaagtcgagatcaaagtcacgactttgttctcaagagagaatttttagtggctcccatttgccccgctatggccacctcatcggttcatcaattggtatcggagccgtactcttcatctaagggactaaccgcccgaagag

SEQ ID NO: 13872 - DNA, 1500 bp, Zea mays
tgaattggggaagtattcgagaaaggaaatcgcagcagcgttaccgggaacggcctggtagtcgccgcggtggtgggcggagaggctcggcggcgggcgcgggggcgggtagctgggcggcccctggaaggtgccgtagtgtacaccgcctccttggggcttggagccgtcggcctcctccccgctcatcctgctgcgcgcccaactcctctggctctaccctctctcctctcccggaggccggagcacgcagtttggtccggtagcctgacaacaagtgacaacgccacactttggacgggaacaggagggatcaaactggggcaggaggaaggaaggaggccgccccgccagctgtcgtcgtggcccatgtgcatgccatgcacgccacgcggacgatcggctggccgttgccctcccgggtccgggcccagcgcccccagctaatcgtttcagaagagaacatgccaaaaggcgaaatgatcgatcgctgagttaataataaccagttgattagccgtggatttctttataagctgaataacgccgcgagacgtggatgatcagatagcatttgcagccgccgcggcggcggcgagactgactggactgcgagagaggcacgcaacgacacgccaggcgtgccaccaaaaaggtcaatttgccacctcattctaaagcagctagtaactattccgctttggcatggtgtagtaggctgatgtcatgccagagtgatattacatgagtgattggatgcttctgctttttaaggatttattactgtatcctatcgtgatttctagagcatcacatgctagtacaaagtaatttccttcatcctttattaactcatacgctgatttctatggactaatttcacatttatcaagagccactcctgtgaaatatttacaaatgatttatctgagacaccttgggcactgcatcagaaatttctctacgctgtgaaatgaaatttcccttctcttcgtcagcatcgactccaagccgattcagaagttttagaccatactgttttccccctgaatccctgatttaattttatgaaatgagacactgttagaggtttttctgtgtaaagcctcatatttaaatttgaggtactagtttaaaataacttgcatgtattccttgacacaataatgtagatcgtaatatttgttgtgttatttcctctaggcacagaatattttgtcaagtatattatcatgtaatattttgtcaagaatttttagttcaggcaacagaacaaatgcaaagcccgacccagtaagttattggcgcctttttcacggcccatcaacggggtgtttgacaacaaaggcccatcaacgaggcatccgggtccgcgcattgcactagctccccccaggctctaccagaaccgccgccgtttctggatctctcgacggcgagcagcgactcgtccggtcgtccctcagcactgtgcttggcggacgcaggacaagacacagg

SEQ ID NO: 13873 - DNA, 498 bp, Zea mays
ataggaatatgatttgatcctaattagatttgatttttaaaaagtttgtaatgcaaaatctagagtctattaccaccctatatgtaagtgaattgctccatacggtctaaggaaagtattttgttctttcgcaatggtccaaacgtaaaagccccaccacgtcacttcacaaaagaaatatgttcacaaacacaagcacaccagagtagggagacgcaggacgcacagagcgacagaggagggagacctcgcccggtcgctccacccctcgcccacatcacttcgtctctctggtcgcatcccaccccacacccctcctctcccatctccgctcgatctcccattcttcctcgtctccgccgccgtctgccccacctccaaccaacgcccaacgatcagtattccagaagcttccccggcaaccttcgtccccgtcccggatccggggcgcccctgatgcggtgcccgcgcggcgcgatcgcgtgacggacggccgcc

SEQ ID NO: 13874 - DNA, 170 bp, Zea mays
ctactgtgttgtaccaccgtttaagcatagatcgatatttaccgcggcaaattccttttcccgctactggcgtctgtcggcgcggcggcgtacctacgtacctgtgcttactagtgtatataatgctgaatgtatatgggcagaaggacatcaatcaaatactcacaacc

SEQ ID NO: 13875 - DNA, 825 bp, Zea mays
ccactatcgaaagggtcactttctaggggtggctacgagcctaccaccctttccttcctgctttcagcctttcactttgttctttgtgggggcagagtgggcattagtggaacaccaccaatctgagatgatcaggagcgtattattgattctttatttattttattatcatctgtgatgatcagcctctgatcatcgtcaccctccatagttttccacttgtcaccggctgatcctgctaaccccactacacagccacaggatcctctcgctacgtcatcgatatactgggggcccgcgcgggtacgaagaagagagagagaatcggaatgccccgtgctggccagtggcctctcttcttcccacgcgagtagggccagcctccaggccagctttccgccctgatacgtgggcccagcaagatccgggccccccacctggagtacatcccgggcccacctcgaagcacccaggcagcttcgtgctcgtgctcgtgccgtacccgacgcatcggcgtctcctcgcgcatttcttctccccccaccccccttcctcgccgagcgcatttctccgtgagcggaagatccgatcaccacttcggcgccgcgcgtccgaaccccaacccaaccgcgctgtctatcctcctcctccctttccgcacttggtccggcgatcctgatcgaattggaaccgccttcacccccacccagtgcagtgctcgcgtgctccgctctgcgccggcagcccgcccggaccggaccaggccgtctctgcatttgcgcggatccgccggcgcggtccctgattcgggccgcgctctcgcag

SEQ ID NO: 13876 - DNA, 704 bp, Zea mays
attgtgacacctgctctctagtgcttaggtccacttgtcgagacctaaggcccacgtgtgagaaccaaacaaaaatatcatattttaaaaattaaatcgatacatatatatactctctctgttcataaatatatgacaccattgattttttaaaaaactttgatcactcgtctcattcaaaaaaataatgagttatcatttatttttttgtgatttattttatcacttaaaggtagtttttgtttgacttaaaattttacatttttaaataaatatttgaataagatgagtgattaaaattttcgaaaaaaatcaatggtgtcatgtatttgtgaatggagctagtatatataatacccatattgaagaaacctgcagcggctctcctctccataaaggcaggcagtgaggagcgattgaatgctgtgttaatcgcgcctcacatgcagatgagctctcaacatcccgaatacatacggcgcaattagtgctccatgttatcgccgctcaagggcactgaaaccgttatgaatcagctaacaattcatccaaacaaagcaatcaacaaccttatgtaagtatctgagcttctagatgcacggcacattaattgtctcgtcctactgctagcaccagaccgctgtcttcttgagcacattgaggtcttcggatttctccgggggtggccgcgcgcagcaccggca

SEQ ID NO: 13877 - DNA, 905 bp, Zea mays
attaaaaataagattgaatctttaacctagaaatgttcttgaataggttatcaccatccttgtgcgtgtgcttttgtcaaagaactctagaaaatgtataaaaaaaaactcgacaagaaaacagaagataagtatcacaagcgagctgaatgattgccacattcaaatgccgattctgctgcacacggcatggctagtttatgccaagaccattcttttacctttccctttctacctttagatgctcctttgcctttacatcgatgcacaaaatgaacataaaagcagacagatgctgttagaataacttggccaccgggaaacaagggtatttggtcccgtgaaagcccagtacctacacactctagtactctaccggtcgcagcagctagcgcagacggtggcaagaataacagctatctatatggcatgccagttgcgtgtctacacctgcatggtcagggaattttattatcatttgaaaaaagtagaaaaaaaaaggcaaagaagcttcaaggagatgaccaccatcatacatactgatcaaatatatatatatatatatatatatactttaatttgtcccacaattaaatcttttttccaggaataaagctcgcatgttgctcaggccgacagagctggatggcaagaacagaaaaccacgcgccctgcaggggttcttgccctcgcctggcttatataaacccagcccctcctgcccccctactacgcagtgcatacatcctcaccacactgcaccatcattgcattagcaagcagtgaagcacaaagcacaaacaaagcaagccgatcgaattaataggtgcagcatagtgctcgatagcttgctcagcagcaagcaagcaagctaggtagccgtgtgaggttggtcgatcgacgag

SEQ ID NO: 13878 - DNA, 1500 bp, Zea mays
atctccggggaaaaacagttgatgtgaatgaatgaattgaaatatgcatgctgcatgccaccgagaaaatagttgattgcgaatgccagttgataaatgccccaggtcacaagagatcgaaatggatcttctccgcggccactctatagaggtgaagaggtgaaatagcgggtagtacttttggctccatagtggtgatcagcacctttctaaattagtattcgctagatcgatcgtttctgttgatagcagttggggcatcggtagaagagatggaaggtatccggtggaagtctcatatttcaggacaggacagggacaggatgagttcacatccttatggaattggaggccagatcggtatgacttgacttggttcttattgcattgcggcgggtttcaaagtgccagtgccagcaatgccgtcctcttatctatactatactatagtgccgcgcaatgggatcgatctgtcttgtggaaagaatctgctattgggaacggaacaacaggcattcgcattcttctatttgagaattcctaccgatggtcgaagactgatatggattggagggaataggccaatctagaactattctattacaacatttctcagatcttcggactcgtttcgaggtaaatggtcaaatcaacttatgtggtttttcccctgggaatatgcacctgctgcttcttcttctgttgcaaggcatgatatcggtatcgaaactctactcggatctggagaaaagggccctgctttcgaaagtgaggggagtcaagctattcgaagaacgggaacaggactactttcggatcggaaagtgagatgttcttgctttgctctagcgtgagtcacaggaatccctgctcgtcatcaatcattatcgggatctgggcctgaaatcactggtttcgaatcgaatctacttctttgtcacaagcttctactgtactgatttaggaactacttctacacttcgccctgcgtatggtttcgaattgacttcttctccggttttatagggctatcgtttttagaagctaagtgaaggtgccggatggaaactcactcttgactcgccatctccatatcatagcttgtgttctgccgtgagcaaaagagttctagaaatgcatagagcaatgaagtgactccgtaacaatagattcgtaatgaagtgttccccaatagattcgtatttcttctagcgctcgtgatgtgagattcgtgatatgagattatatacgctttacccgaggcagatagacccaaagtccagaatgaatgattggagaaagcaaggtcaagtcaagaagctaagtctagtattgcaagggaacaagtccgtattggcacgattgctagctgcggtagcagaagtagatgtgcgcctttttctagaatcgaaagtgaaacatcggtgtaaaagattgagtgggtttcccatagaaatagtcaggggcgggaactacccgcgacaatggtgaaactattgc

SEQ ID NO: 13879 - DNA, 190 bp, Zea mays
attttacacaaagcaacagtatcccgatgttttgattttttgttaggagatctgtcagatgcaaatgtaagcattgtcaagctttgctttgccctggcatctgcacctgagatgaacacccatattctttctcagcttcaagttgttagaaggatagggaacctacttgagttttgtcgctgcaaaagac

SEQ ID NO: 13880 - DNA, 1500 bp, Zea mays
catcactgctctgacttctgatgcgctggttgtggttattgccattccttccatccatatgtttggacagatagaggaagaggccacagctgaaggctgaggccagcactccttcccatctgtctttgttactaattacttgggcctatgaatctaggatgcagtagactgatggatgtttacaaattacaatgccatcaatgatgatgcccaggatatgctagttacggaatcaacataataacgcaatgataagtaagcataggccatgaccagccatctaataacagattagattattaggccagaccgccagactaatctggttgagcaaacacttccagtggctagtgggaggcaaaaagcctgattaggatatacaactacaggcgccagtacgtactaatcgtccttttgagcattctgtgaagcagaacagaggcggcagagtttcagaagttctgctgccctgttccagtccttcataggtgcaaccgtgcaactgctatactacacgtaggaacagtacatcttcagctatactaaattcagttttttcttcttcttacaaacgcatattttaagctacagcattggcaggccattgctcgatttgtttttttctcggtggttggacttacatgcctacaggaaaactaaaacaatacgtatatgtggttttctgataatcaaatcaaagggggaggggggatgtgacaccagaactagttctttcccatcaccccattattgtttgcttttgcccagtctcgcgaagaaaaaaaaatgaaatcaaaagaaaatatcaaagcgacgagcagcgacaactccacgtctggagccaggtgatgtatgagtgcaggtactacacggtacatagattttatttttttaaaaaaaaatcataagcatttattttatttatccccaaattatgaactggactttgctcgctggtctcgcagcagccgagcccaactgcacacaaaagaaatgggcgcatgagcaggcacagaaaaactaaacagagaaagcatgcattaattagaccaaacccaaaacccctaagcaaaagattagcaatgattggcgtctccattgtgcacttgcacaggtactagtactcctgctaggcttgttgttgtagggtgcctgccccatgcagtgcaaggagggaggggtgtgtcaccataaaaatttagcggcaagggcgagggcgattggaagctcaaaataatgagctggttgcccaccggggagacacgccggatttgtttaatcccctggccctaatcccccagccctgccgtctcctccttataagcaatggcggaggggtcttgctcttgcattgcacctccggccaccgcgccatagcccgcagtaattaagcaggcgagaacgacgaagaggcggtcacgcaccacaccgatcaatccagctcgagcgaccgatcacacgtgcagcacagcacagcacagcggtgctcggcgaagagag

SEQ ID NO: 13881 - DNA, 585 bp, Zea mays
cacaggtactaaagaattgtagactgacagagccgccttcattcctggcgcgcacgttcaggcgcttctcttgccttgccgtaacggcttttaactatttcctcctctcctcccgatccagctagcctggcctcccacctcccctcccctctcttgaactgaatcccccactccgtcctccagttcgatcgcgttcgcggccccccactccgtgttccggaataagtagccggcggtttcctcaccccaggttttgcagttgctggggagtgggaaattcgtccggctccggtttggccaatgctcctgcggtttcttggagaggccgctgaagcagcagcccttgcctgagggattctccttttctcgggcggagagttcggttgcggcggaaaaaaaaaagaattctttcgtcggattggcccaagttcttggttgatccgttacaaagcccccactgtacgctgtgttagcctttttccacgcgtttctttccttactctagatccgtgtccccgcccgattatttgggggaataggcagcccatcgatcgggggaagagggatttggaggcctgacctccg

SEQ ID NO: 13882 - DNA, 801 bp, Zea mays
gggattggtcggtctcccgcctcgcagacttgctcggcggggacttggtcgttcgctctgcctcgtatacttgctgggcagggtcttggtcgttcgccccgcctcgtagatttgctcagtggaggcttggtcagtaaatgagccttgttttatatatctctttcaacatgaatattttttcgttcattttttagttatgcgaatgacttgtgttgggatctggcactaggaaggtaggacactcgacaaaattaacagcgggtggatgacattatttgcttaaggtgatttgccgagttttcttttgcctgacactagataaaccacatcattatcgagtgtttttctttatctaatgctaaactatatttgtgaagtatttttctttgcctatgtactatgtagcattcaacaagaagactcattggctagtgccgtaaatttagcacaagcaaagctctccggtagtgattaatagttaatacggtcgaggactcgagggtaactgggtaactatcgataagaaccggctgcacaggaacccgctagcggagtagcggccacgttttaccctctcaccatcctcctcccctccctacaaaaagctagcagagtagcggccacgttttaccctctcaccatcctcctcccctccctacaaaaggagacaacgtccgtccctggccatcaccagttcaccgctccactccactaccgccgccaccccttcaacacaacctccgcccccggccgtaggggagggagggccggaggaagcgaccgagcaacccaccgccggag

SEQ ID NO: 13883 - DNA, 1500 bp, Zea mays
tctagttttgtggctcctaaactaattgtttggaaggaggaaaaccgggggcgtctgcccaagttctcgcgggtgccggtgccgcacaagacgtttcaggcgtcggaaaacttgggctgtcggtagcttatgggccaggctgtggctgaggacattcggccgatgaaccaggctcttcgtatcgtgtcaagcggcctctatttctgttaaattggaatatgtctggatatttcctaaactaaagtatggtttgatctgctcttactatttcaaccggtccaattacttaataaatttgttttctatatgtatgcattaagttcaaatttcaaaatttatgtggtcatagcagacatcgtattttaagataaagttgcattacagttttttcttcattatgtttcttagaattttatagatccagtttttttattactagatgccttaacctacaataataataataataataataataataataataataataataataataataataataataacaacaacaacaacaataataaatttatgttgtcatttgccataatcacacctgtctctaacccgatcctgaatacaaaacaatataattaaccccgaaattataaataaatatattaagaataatatttattaaaaatatgttaagaattattcatcaatatttcacatttagttttgtaccattaaaatgtattatcttatcttattaataacctataaaaataattattaaaaatcataatatatttttctatgctaagttatatcagtagctactaaccaacaaacgttaaactaaaaagtcagtttctatataaaaaaataaaaagacaaattttgttaagggctaaactaaaccaactcaaattagcggaggagtaaaataaaccccaaaaaaatactttagagggctgtatagacattgtccataaataaaggaagtaatatgtactttttccctcatagaataagagcacgttaagtagattgaccatacaggtatttaagcaacacttttccaactaacaaaaacaacgaatttgcttcatgtattgaccattccgtcacttgaaaaaaatttgcattccatcacttgttttccatgtttatttcccgcgagtaattcatgtctttttttcagtcgctattgcccctctcggttcatcagcttgtgtatagaacctgcaagaagcttagtgcacatgacatacacacttgtctgtccaatcaacaaatatacttacaagtcaataatgcagcactaccaaccacgtatcagtggccagttcaaacgtagtgtagctgtaggacatgcgtagcagttgtggaaaactttttcctagcgacagcttggtttagacgacagatcaaccagggacagcgagagcattgatttttctaaatggcgcccctgctgttgctgcgtaggcgcgtagcttttgtgctggctgccgaccgagacgagctgacagtaacaggcgcgcg

SEQ ID NO: 13884 - DNA, 554 bp, Zea mays
tgggccctgcctcctgtgctgtgctgggccgccacgacggaatgcgagcggattcaaaattcaaatgcccgtttctccctgttgaagttttgtcacggtcgccgtcccgtccctccttttgaacgtttcaaaggggatctcagggtcagagcgcatcagcacacagacagcgcggtgctctccagtccccaccaattaagctcagggtctagtgagcagccagagagcctcgtcccgttcccacccccattgcttgctctgactgctccgccgtgcgtgcgtcacccgcgctcgggaggtgagtggtttggttgcgcagccaactgccggcccggcaccgtaccgcttgttcgcttctgaggttgtgcggagtggttgctggcctggccgtggccggcataccgataaaggcgagagacaaggcgttgtctcactctcatccgtcgtccgtctcgtctcggctttctcgcctcctcggcggcagcggtgttccactcccatcgcgtcgggacatagaaagggggagcgcgggcgacacgcgagcgttagttgcc

SEQ ID NO: 13885 - DNA, 694 bp, Zea mays
actcaggtctgtattctctgttgctacattgttgtgttgtgatatttggtacttaccaatgatgccaataatctgttgcccgtctgaaggactctgcattatgattttcgcctcttctgaattgttcccggacattggagcttttggcctcgttgcaagtggcaaatcccttgtgcttaaaggttgcaatgtagtagtcccgttgcaacgcacgagcactcacctagtatagtataaagttaaagataaagataaaagatttataggccttacgctaaattggcgaagcccactctatgcttcaacattcgtgcgcctccatatccgacagccactgccgatcggccccacgagccagcgaacccggctcgcaactcccctccaaagccagcacgagagcaaggtcccctgatcgccgccgcttccctcgccccaccgccccagcaccacctgctgacctgcacatctccaccacccgtcctcctctgcgggttctccgcaggacgcgacccttggccgcggcattcgcccgaggaatcgccgctcccgcgaggcctccgtctctcgccgtgcccggatcccccgagctgccttcagggtgcaagatctcttccgtgatccggagccttcaccgtttcctcctctctgatcttagctcgatatcggagcgactggcccgagcttctcttacccc

SEQ ID NO: 13886 - DNA, 327 bp, Zea mays
ttgccgggtagcagagttggctaggctggacaaactgaagaagctgaccatatatattaggaagcaaagttgcagtgacagaaaatgaactgaatgagcttgagaacatcaaaggcctttgcgtgctgaaaattacatagggctgtatcactttcaaagaaagaacgagtccatcaaacttctgattctacaccattgataacttcactctccctacctctaaatctcgaaaagctagacctgtgctgcttccctggagagaaggtgccagattggttaagtccgagtaagctgttgagactgaagagactctacttcactggagga

SEQ ID NO: 13887 - DNA, 367 bp, Zea mays
gatttttatctgcgaccttatagatagtagaatttttttacgtttatcggttgccacacttgagttgaggtcatcggcctagcttggtggggctttggggaaaagtcttttctacccctacctttttaaccatgaacttgggtccatctttcttccccgcacctcctctcgtctcgcgtccaccgcccgcgcctagccctctcctcgcgtgcctctcgcctccggcgccccaggccgtgcttgcctgccgcgcccaccgccggtccgcgctcgcgcctacacggagcatcaggagttcaggcgcggcgaacagggggaagaagcagccaacctcgctcgctactcgctagcctagtcggcggtcgcc

SEQ ID NO: 13888 - DNA, 1500 bp, Zea mays
tgattggcttgttaagcaaaccaacattatgcatggagatgtgcgacatccaccctattagatctagataatcaataacactatgcttggtaggcataccaaaagatgattagaatctttataggtgcagtagttggaaggacatcaaattgaattattatttttttctgacggaagctattttatgacatttgcgataggaaaataaaacgccacaaatagtcatattaaatgtgagataatatgaccctttgtcatggtgatcttcatcaccacgtcctgcttcgtgccttcatccttgattcctccatgatgacatcaagcatcacatatacatttgggtcatacacataccattcactatttttcttgcaaaaccatggcagatggagagctaaatagtatgtggatgtggaaagggattatccaagcaatatgtgtcgtacgcaaatggtggtctttgggcaacacttttgaaatcttagaatttcatcgatcatacaaatgaaatcactatgaaaatcttatcagtttgatcaaattaagccaaccctgagacgttccaaatgcctttattcgttaattatattataatcgtgcgaggtagaacgataacagtacatccaactcaaatctattgcctttcttgacttgaaatgtacacgcattgttagctctgatggcgataacaacaagttgtgcgagaggtcatgagggaaaagaaactgatattatgccccaatggtgattccagccaggggttgaggggtaggggcaaatgacctgtgcgactataccgataactactccatccgttctaatttatgctataaccaaagcaaaagtagatccaatctactaggcaaatcacctagatgcaaaccatcatgataaaaatatgtgcatgaacgactttggtttcattgaagggaaatgggtacaatcaagataacatgcgagtagaagatcatggatcattaccagtagatgtgcagcacagcgaaaaaaacgtgacgatgcagtggaagtcgtcgtacgtcctcacttaccaccaacacgttaatctatgctcctatttgttgctgatcaacaccgcagtagcgtctccatggtaaccacacttgcgcaataaaacactacaacatcaatgtgctagcaccacgcacgcaacggaggaaagacagcggcttgggtgttctcaaccttagggagagaggtgcaggcggcggctaggatgcctcttgattctatcacgctagcctcttcatgtatataaacccttgctaatgggcttttaacctaaatgcccattagcgttctcatgatcatgattgccccttaagtatataatcaaccgttttgttcttgtccagcttattgaacttgctcgttataattacaggataagccttttagcttttcatgaagcattggcacgcaaaccatgtgatcctttgatagtggctacttttgcactagcyttttacctgggagggtgat

SEQ ID NO: 13889 - DNA, 347 bp, Zea mays
agtggttggtggccctggcccctggggccctccccgggcgcgaggaacatcgtattgaagcctcggaggtacgcaaggagcacagaatgacagctgcagctaataaaatcttctggctcctcccccttcctcctcagcactgtctcgattcatcgagggttcgttggattcgagggacggctggcacgccaccatgccggtccgctcgccgggtggaggctccaaagtcaagggaggcacggggttgaccaggctgttggccgttggttggggaaccgggctgcgcagtcgctcgatcgactttcggcgaggaggccgatctagtcagttggatcggaggcgcgaca

SEQ ID NO: 13890 - DNA, 676 bp, Zea mays
tctgttaaatattgtatataatgttactaattattgtcctttagttggctggctaatttgccacactttatctaacttttctgtctaaggtcagttcttcaattcagacgactaaccttagtcaaagtatgacacagttaatcacgaatcaaacaggcccagacccttaatccctaatgtttcttaggtagttgaggctcgcattgtatcatttctatctcgattgtatgttatggcaaaagagcaaatgttttcttgtaatttccgaaaaaaaatctatgattatgtgctgtcattgtactagtatcatataaagttataaaccttgtcttaaattattgcacaatcaattggcgaactgttccaaaacgtgttgcttgctgtacacggatcgatcaggtgttggctcgttaagcatcagtgacgccagcatgctctcgttagtacacatcgagatcgagggatcagtactcactcgcagtcacaccaaatctgagtcctccctgggcctgggcgcgtcttcaacgtgcagcggtttcttgtagagctggaggagcagacgacgcccgtgaaagggaacaagacgccggcggcgatcggcatgcctaggatgttgttgcccagggcccacacgtagttcagccggatcctggagagggtcttgtgcgagagatca

SEQ ID NO: 13891 - DNA, 881 bp, Zea mays
tttgtttcattccttttatgaccaccgatctttctcctgtctccctctctgatctgcatttttgtcttagagctggataatttggaatgtggtgtgttttgagatgcatgtattggataatgtcgaatagattaccaccctgtttttctctacatctccacagaagtctgatgctgaatcttttttaatgctccctctaggctctagcctatgtaacattggtcccttaaattttattataatcaattgtttttgtgcaactttttaagtaacagtaatcatgtgatattgctctttgagaattttcatatccagaagtgtgagaatcctaacaacaatgaaatatttctgagcaaatcttcatatatttcactgcattatgcatcctttgtcatgttggaaacttatatggcaccctttcaatgaataatactaaggcaagtatattttttaactaaatgatgcttagagtagcaaccaaatagattcctgatgattttacttattttgaaaagatttttaacccgttgcaacgcacgggcactcaactagtatatagataataaagtatagaggcacagatagagatatagagatagatatattctcaccacaatcactacagtacaacattcacgagtgaccgcggatgcactcgagaggacaaccgtaccacggcgccttgcagaacacttcccaagcccaaagccattacaccaaccactctcgggctctgctctatttatggaggagcagccagctacaggctacagccgtggcgaaagcacacacggatcaatcacactcactcgcggccattgtcctgcccgtgcgtgctctgccttttcaggcgatcgaccaaccaacttctcgtcactgcc

SEQ ID NO: 13892 - DNA, 1102 bp, Zea mays
ctagatagtgacccacataagctgctagcagaaaaccaggagtaccaaaaaaatttaatgcacatttaccactgcatattatgcgggtaaggcttgacgcttaaagatacccttccccggaccccgcacaatgcggtaagcctacggcactgggtagtgagtacgccctttttaccatttgttaagtacgccctttttaccatttgttatgttacacaagatggtttagtctgaggttacaaattcactcaagggtcaggacaaaaaggtactcaatatctgaaaccctagaaaattattcatccattgacatatggatcccctaataacagggcctgagcgggtatgatgtcgtcggcgtggaggcacagcgaccggcggagcagtgaagggggcgcggcggctttccgatgctgctggctgctgcggcggtcgcctggggctctgggcgcggacaccatcaccgtgcctgggggcgatccaatgaattggtctgggccgggggcagcctgactgccgccacatcgtgtaggccgccctgtcggtagatggtgattaccgcctggaattgctcagtcctaaaatattattactccagaaaatccacgctggagtagtgtttggaacttctccggcctaaaaatctggtgaaatcggtgaactaggtcactagctgctctagaaagtcctgaaaccgtagttgtgaaattttataagatatttagataactattttttatttattattacaatttaaaatatttttaaactatttaaatttatattatatactactctctccgtttctttttatttgtcgttggatagtgtaaaattgcactatccagcaacaaataagaagaaacagaaggagtataactctacgctggagcagttccaaacaccctttaaatgtcactacagtatgagtgttgctcattttttttttgaaatctctactaactattaagagaggagtgtagactacccccgctcccgcaactcccgctcccgcaacgccccgccagcgaaaccctcgcacgcccgcgcaactacctcccgcgcgcgccgcagtaggtttggaggataagattcgggagag

SEQ ID NO: 13893 - DNA, 130 bp, Zea mays
ctgcttgcctacgtgaaataatcctccgccctgcgctgctgttaacgccctgaccgtgcaagcacggtcataattcgttatgcttttttctggcattattgcgcgttaacagcataaggagcgctccggc

SEQ ID NO: 13894 - DNA, 351 bp, Zea mays
cttccctgatctacctccctagcctgccgccaccaccgtcgtctctgcgccgcgcagatccgccctgctggtgcggcaccactcgagcatacgtgtacggacgcgacgagacgtagtccccgcccacctcgccgaggactcgttcctgtttcgtgcgcgccagcactaccggtgtccgtgcgtggctgggccaggtcgattcgaccgaatccggtggagttcaccgtaccgtggtgtcaaatcggtgagttccatagtgttacgcgtgggggaggagcgttcgggtctgtctggccggaagtggcgctgggatggctctagggtttggttttgatcttttggcctgagggc

SEQ ID NO: 13895 - DNA, 167 bp, Zea mays
cagtagatcattttgtttaacagcagggtgcagggcccgtttctgttgctcggcacccgtcccatcccacccacctgctcacgacgacaggccagcacgacacggagggaggaagtagccaggccacctcgcctcgcctctactctcccgcggtcccgccccatacc

SEQ ID NO: 13896 - DNA, 728 bp, Zea mays
tctgtgtacggttaagcgtaagtaaaagaaaaagaattataaaaagaacaagaaaaaaaataagactcagctgctctccaactataaaagtggtattgggatacttagttggtcatcattttgtttttaagtctttactcaattattcatttgtttaagttaagaatgcatacatgctcgtcctgaacgacctcacagcaatgtaaagggaatagggaagaactcccgtcccttaaagtggcctgtagggcctaatcacttagccacctagctatccttctatcatcctaaggcttcacgtcctaggtctatcctgctcgtcctactatctatccaacattgtttctaacaagttttaccttgggaaaagatggtatttatattttattgattcctctgtggtggtacaagctccgataccagctgtggcggaacctgcccgaattattccgacttaagtgcttaagccccgccttagaggctagaccacacttaaatgggaataacccatcaatccctcggatctagtccgacacggccactgacaggatcaagtaccacaatctcactcgaaggtgagtcacagagcaaatacaataaagcataaaaccatacaggtcagagtattaaattattacatcaccatcatcatcatcggagtttttgcaaaagtaaccatcattgttcgaagtgtagcggaataaaactaacgataattaaacagagag

SEQ ID NO: 13897 - DNA, 1207 bp, Zea mays
tgtttctagattaaggggtcataaatacaaccaccaccacccttaagaataagttctcttcttaatttgatatataaaggtatactatagtcattgaattcattgtgtataacatgctgttgtagtgcctttgtcttaatgtactgatctattgatctattaagaagtggagaataaagctaaaaataaattgttaagaaagtaagtttataagtatataaaaggtcaagcaaagagaacgttagatcgatctcatccagttcggtcaaaggaccaaaaccggactcaaaactccgcgtcttgatgacgagagcaccaaccttatggttgtggctctctttcgcaccgtgtgtattaatagggacagaggaagatgataagtaaaccaacattgtgtggagctagctacatcacccctccctaatagcttcgcggtttgatctagcctgtaacagcttttttttcaccacacaacagcgatgtacatcttttatccacgaccatataaatacaacatgtcaaaactgtaacggttttccacctcatctagctgtacgtgggtgcttgacgcccggaggactagaggaacacgtaatacttgcacttgcacctccccgatgtgatgagcagtacgtatatatgtcggtgatgggagtggctggttacatcgaaattcacgattcacgcaacaacaaaaaaccatgcatgtttgaaatttgtgatccgaaaaatcaaacacactgcacgctgttggattggcaggacaggatcggagcgtccggacgtggcggccggtcgttctcgcatccgttgggccagccagtgcgtgtggggcacgtccatcctcttccttcacctaccaccggttgtacctctcatgatgacttgggggagaaaacaagtgtacacacttacacacgcatgcattacaaaaatatatgtgagctttagcatcatatctcagctctagctagctagctagctatcatatcataaaattcataatcctagttcctaaaaatcgtattcactgtcatttgtagccactaaaactatacacacccggccgggtatgtgttggggttaggcctatatatactcgtgctgccatgtctccacacattccatcggtcgtgaaaagaaaaagggaaacaaaccaagctagagaaaagaagaaggtactacatactagctagctagcttagct

SEQ ID NO: 13898 - DNA, 286 bp, Zea mays
cagaaccaaacattactaaattacagacagggtgccatctgaaattaatagaccataaagttacatttcaattacattgggcacctaggttcaccagtcttgttgctacttgttccatatgtgtgatttgtttgaaatttcttgtctataaataaaaagtaaagtaacttgactgccctgtgttgaacccatatttttcttgcagtgcactgcattaaaggcactgcgatccttccttttgtatctgggttattcttgaagaattaattttcactctggaggaaaa

SEQ ID NO: 13899 - DNA, 529 bp, Zea mays
tgccttctgtctcgtggcgcaccggacagtccggtgcacaccggacactgtccggtgcccgatttgtttccataaaaagcgaagccgaccgttgccgaccgttgcagatctggcgcaccggacagtccggtgcacaccggacagtccggtgcttccttccgaccgttggctcggccacgtgtcgcgcaccgatcgcgcggccgaccgttggcccggccgaccgttggctcaccggacagtccggtgcacaccggacagtccggtgaattttagccgaagtcgccggagaaaaacccgagagcggctggtttgcgctgcgctgatctggcgcaccggacactgtccggtgcacaccggacagtccggtgccccagcccgaagcagcctttggctgtacacagccactctccacttcttttcttttcttctttctcctgtttctaacacttagacaggatgttagtacacaaaactaatgtactaaggcttagaaacatacctttacttgtgatttacactttgttcatcc

SEQ ID NO: 13900 - DNA, 1190 bp, Zea mays
ctgcgttgaaaaacgcaacatttttttatgccatataggctaaaagaaaggtaaagcagataggcttcggttcattattgcaaatgaacattgaagtaattgagcatcggatcctcgctgggctcttgttgtctagtgtgtatgactatccttacacaaagtcagtgcacggcccttgccaataacagcagagactgtttaatttgttattggattaccaagggggatgagaagtttcctgagctggactactagtccatgagtactgccagatccagtttggcacaagaagacaaggaggaatatatgggagtgcaagaggaagcaattagtgaaaccattatggagagacataatgctcaagtgacattgaagatccaatagataaagtgggaaaaagtggctatgatggaatggcgacaagtcagacagagcaaaaggcttggagagcaagagcagtcagatcagatgcatccaactatccaaggtggacaagggggatgagaaggctaagcaagagtagactgaacgtaactcaaatctttctggggacccctttgcagttcttgctgatattgatttacttgatatttcttctaaaattggaattaatcaacatgattaaaaattttaagatattgatatgatcaaagatttaaagacaactagagctgctctgagtaaaccaacgatagttgaaaactaagaaagtatgcgtccagaggctgtacctcccttgaacaaaccttgtgtggatggcaaactgaagaatatgatgttgaggtttgtccaattgttaattctatttaaaaaatagaggcaaatttaacaagaaattaataaactagggtctcatttggtattgtagaggtgcatctaagaaagggttgggtacctttcttaaggacatttgggattacaaggtcgatttagttagtttacaagaaaccatgaataagacagtattctgaattcaatgacactgctgatggcaagtgttcgttttcgtctcccttcagctgcttcagtgcatcaacagaagcgcgtctttcccgttctccagtgtatcaacactgctgataccctcaatcgcgtcatcgcttgagattcgccacctcaatcgcggcgatcctaacgggaaccgagcagggctggtatctgcatgagcagcgtcgtttcccacgaatcca

SEQ ID NO: 13901 - DNA, 1021 bp, Zea mays
ttgctaatgttaatgacataagtggtactaaaaatctgaaattaatatgccagtactttttttctcgtggaaactggagaggagaggtggactacgcgatgtgatccaatcttccaatccaaactactaaccatccgatcatccaatcatataatccaaactataaacccttcctcgttcctccttcctctgctactctgtgtggaggatggagagggtcagagggataaatgggggagggccgaggcgggggcgtcgctgttgctgcgtacctcaaagcgttctgtgggatcatgtcataccgctggaacgctcgttgcttcctgagctgttggtcgatgtagcagagaggaggtggcgcggccgcagaggaggtggagaggggcggcgcgcggtcgcggaggaggcggccctggcggcggcggcgcggaggcttcgcgcagtcgaggaggtgcgcgtgggagccggcggagggatggcgcggcagccggcagagccgcgtcggggctggcggagctgcgcgcttcggcggcgggagttgggagggagaggcagagggaggaagcgaggctggtcgggccggtggcggagcaggcgagcggggcgacggcaaagaggcgagggcggcggcgtaggcttgtggaggcgaggaggcgggcgaccgcgtgtggaaaccagagagcggtggatccggagggaggcggcgccggagggagtggacaccgcaccgttcacagctggatcgaagaaagatttcgggtccgttgccgtgccgtgccagtagccagtgccggggtacagtccgtactccgtaacgaccccgccacctctttcccctagttttgttagccatcatcatcaaagaatttcaagtcgcaaagcgcgacgtccgacgagagagagcggcctcagaacaggagcgaagggatccgccagagtccccctgagtccaaccaagctcggtccggcccagtcccaggcccaggcccaggcccgagcggtagcctgtaggtcgccggcg

SEQ ID NO: 13902 - DNA, 595 bp, Zea mays
tggtctggtcctggcccaaagtgctggatgtgtaaagcgctttcctcgttggaaagcgtctacccggcgagaggcgggtccagtcggcgactagccacgtgtacggtgtgccctccttgctccgccagtccgcctggagcacgcgcgaatacatccagcccaccccctgccgcctcctcctctataagacgagacctgcgcaccggcaccgccatctccgtctccctgtctcaccggtgccgcttcccctcacccgctcgatttactgcccaatccggcccgcttcgccccgccacgaattttaatcaaccgtttggagcttgaatttgaattccagctcgaatcacccacccggccagctgggagcgagagcgttccagctcgaatcacccagcccgccagccgggagcgagagcgagctgggtgagctcgattcgatgcgttgctgagcgtggctcaatcgattcaggtcgggcggtggcgcagtcagagggatctgaaccctagcgccgtccggatctgtgacccgcgctgctcggcgcgtcggcggcatgagtgcctggaaaacgtggcgaggaggagaagcggcggggat

SEQ ID NO: 13903 - DNA, 82 bp, Zea mays
gatacaggcagctgggacaaagagaaacccatttcttgagccagcattgccgcctggagagaagtatgtatctgaggttgat

SEQ ID NO: 13904 - DNA, 1500 bp, Zea mays
acagccttttaacatttctttctgaggctgtcattaggtcctggtgccatgtcatatgaaacggtggcgacagaaggaaccgcccccgctatttttttgcgtaatgctaagtccctgctacgcaggtgacaaacatatttcacgtaaatcgatccatgaagaacttgcaagcatttataatatttcacaggaaaaaggcgcgtgatcaaaattgcttacattattgcagcgtgacgaatcatcagaaaatagtatttatgataaaaccccaggtcggatcagagaaagtttagggaatattcccactgatcagtggcccaaaacgtattgtcacccacgcaagcgacgcataagtcttttttagtattattgaaaagtgagttgtaggaaactctaaacagatatatagactgaacaaccataaaggatagcataaagaaataaggccctttaggcgtcatcgtcgtttgtgcaatgaagccactgcttctcatgagagcactgtcatcaccttgcaactggcagttttcaattgctgtaccagcgcaagatccacatattaatcttgtacgcctcacctgccccaaatggaggatgttcactggattgctgtcccaatccaaccatctccttatccgctttatatcacagctttaacatgaatgataaatatcgctgaacacaagaggtgttgcaattttaatctaggcgacaacttactcggtcaaattctcaggccgaggtccgaggaatttctcttttgttgcaggagaaccaaagtcccatgaatgaactatgaagcagcagctcggtaatggataatgatccaccgactacgctgcttccagcagcatagtacagcacgtactagcttgtttttcctcagtttggttcaaacgtccgtattactatagtcgtgttactatagttgtgtatgtgcataattgttttattttcatttttttaccgcctaaaaaatttcctggcaaacaaagctcttgtcacccctcctaaaaaaatatatatatctgaagattttggatggatgtatcagtagatgcacggtagaaataaaggatcagttcacatatcacaccgcgccgccattgatttgtttaggcaagagatatcactgtatgctccaaaggtcttgttcctcctcgctgtctcatggcgtatcctaacgtgcgtgtctcgacctgaagaaccacaactacacatcaattcagcgagttagggcggttggtcgaccagtgtcagccacaaaacgcggccaaaatttaaattatcaatcatgtggtgatcattgcgcaccgcccatagtattgtaaggcacatccgaggcaaggcagcgcattatgacgtgtatttaaggagactaagctgaaggaactctcgcatcagcggcctgataagctatagccatcttcttctcttctctgaattccagtccaagggccggaataccgtcagagggagtgggagagggggggaaaaaag

SEQ ID NO: 13905 - DNA, 50 bp, Zea mays
tctcgtccccgccgcagccgcctcgccccgagctcttccgcttccagagc

SEQ ID NO: 13906 - DNA, 1500 bp, Zea mays
tttggaatgtgatcaacttcttcatgtgaaatatcaacctgtgcttaagcaagaagtgcattgcctcaccaaggacatgattttgttgaatggcaagagtgaacaagcccaacttgacctagataacagtgtcagtggcatgaaaaagattggtaaggaaggaaccatggtgtgctccactggctacaagtcatgtgagtgcaatgaggcagggaagaaaataagaaagagaaaagaagcaagctctccaacacttggaccaactgggttgacaagaataaggtcaatttccctttttgctcaagtagaaaagcagaaggtccgctaagtcaccgtagaaatttgttcgagagagccattgatgatcgttggtatcttttccctagtgccttctcgaatacactgctagaggatttatgtgttcctttggaccttttgagagactcttggatcgcacttgttcagagaatttaggcgttcaaaactgtcgcctggctgttggcctcaagcctaagctccgatactggccaactctataccactggagttttcccgtgattatagcgtccatcagactagttctcttgactagacccaatgctcttgcatagagaccaatgagctttgttcctycacttctcacccaggttttaaatttttgttggtaacaagttcttgttccacgtacaaataagggtaacaatatgatctaaattttatactataaaatgtaataatcagatcagattaggatgtgactctatttctattattttttctaacaatttgtaaaaaaacatttagatcgagatctactaccagcccaggtgatccattacctacagacaacccgttgggtagctatgacctaaatgggcatgatctggcacaaaactaagacctaaacccaatgatcttgcatagagcccaattgccatctctaggagccatctctaggtttgctcggtgtttttttgtgtggccactgaaaagaaatgaagcattagtcaaatactacttccgttttttaatatttgtcacccactagtttatttttaaactaaaacatgataaataaaaaaattctttaatatttgtcacccgctagtttatatttaaactaaaacgtgacaaacatgataaataaaaaaaattctttaatatttgtcacccgctagtttatatttaaactaaaacgtgacaaataaaaacggagggagtacgtatctgtaatggagatagagcgtaccacatttgtaagcaacgatcatatatcacgtgtctcaatccgatcaaagcataacatgtccaaaagctacagcgtggcaacgtggctcagtttattttaggtaatcttacagaccaaagctaccaaaatagcttgggaactgcgaagtccgatgcatgtatacaatgcaacatcacgtagtacagtaacacttatgtttcacagcttgctcgagtcaaaaactagcgaaccccttctctttcaagctttcg

SEQ ID NO: 13907 - DNA, 1500 bp, Zea mays
catctgagcatttagtgcataggcagacagcacaatgaatatgaattgagctttcaatataagatattgaaattttaggtgccgggttattatataccagtaggcacatgaaacggagcagccctaggctatgccagggccagcatatttttcatgctgtgaggtactgttcatggtgtttttaggattaaatttataatttaaaaataaggttagattgagttgattccttgattttagagaatgtctcttaaaagacaagttacccatccatgtgaggatggaattctggttaatcaagaaatgacaaataagtagatctagactttctatctccttatctattcctgtccttgcggtgtagctgctgggaatcggcataggtgcactgcttggattaagggccatcgaatttatgcccttgacatactatcttttatgttcagacacttcaaattaatttattagttacccgatttgagatctcaagtaaaaaaacacatgatacctattgtttgatacttgataccagttttggacaatattcatgacatggtgagatcaatgaacatcattgccagtagtgatatcaatatatcactgaacttcttggcttcagcacattttcctctctttgtaatatattattgaacttctcgactttaacaccttgatttctcgtggcgatataatatggccgctttggattttgtacaatgacgtgctgtgaccttttgattaaatttccccgacatggtacatctgcagggaagttcacgaggaagtaactgaggcaaggcagaaggcctcaacagtaagatctcgacgacaagagcaggatgctgctcgtagagagaaactcaggcaagcttacctgaagaaacgattggagaagttgattgctgaaaaacaggcctcttcaaccagtgattgacctacccagctagctagtatatttccttgcatgttctatcaggctaccagctgtagcctgtagtagtccatggtctcatgcaaccatggaacggttactgtaaatgtcttctgatccagtacagtcgaattcaggaaatagcgtttgcatgtacaggtggtgttgcagaatattgttgtacacaattctaggcaatggcatcatgattttctgagacattcgctagacccaatccatatttcttcagctttgtcccattatatatgtttggctattttagacaatattcccattacgtttgctgtgtctccattttggacggatgtttatagtcttggttctagtagtcgtctgaaacttgaaaatgactcacaaacaagtggaggaagaagcaggttctgtattcgtattccctttgataggataaaaagttcatttgccctttctgtgattcttctccaacttgctactagccattcttgctggactgcatatcatgctgcctccaaactattcctcttcgcttttaaattcgagaagcaaaaccgcgacctcgccggagaaca

SEQ ID NO: 13908 - DNA, 518 bp, Zea mays
ggtagtatgatgctcatatacaaktgttgttttgtcatgccatttcgcatgcttagtatgcataggatattctgttttttaacacggttgtcccatgccatgaattcatgtgaattaatttacttcaaggtgcataggatattcatcatcgcacgaaggcgaagcacattgagattgaaatccacttcatccgtaaaaaggttgctttgtggcaccttcgagtgctacatgtcccttctgcacatcagttcatggacatcatgacttagggactgtctgtacagttgtttagtgactttcagtccagtctatgcgtccaattctctccagctgtgaatgcgggacgggtattagagatatgtatagtctagagatatgtatgtacttgtacttcaaggtgtattttgactatacacatgaaagtcaccctttctataacgagtgtgaggtgttctcttaatcttctacatttatggtgttgtatgatcaattcagtgtaatagaaccattgtgctgat

SEQ ID NO: 13909 - DNA, 1489 bp, Zea mays
tgaagaatggttctctcatggatgttcatatgatgtgactcaagaatggcttaatagggtgaagatagcaaggaaagggcttcgagggactaagcgaaggtgaaggtcatgctacgacttgtggaccgaggtaccatggataaggtgaagaagagagtacttgcactaaatcgatgaactaatcagctatgaagagttatattgtgttgatgcattagtaagtgaaagggaaatgtgcctttgggcatttctataatgtttcggtgattaagtgcccaacacatattctctaagttctaaatgtgccaaagattgaaaaagtgcaaatcaagacatgaggtatgtttctagacttagtacatttgtttttgaatactaatgaagttatctaaatgttagaaacagagaaaagaagaaaagaaaaggattgcaaaagactggttgtgtgcatccgaagctcagctcagtctggcacaccggactgtccggtggtgcaccggacagtgtccggtgcgccaggctggactcctgtgaaaaggccgctctcgggaaatgttctgcggcgtacggctataattcaccggactgtccggtgagccaacggtcggccgcgcaatccgcgggcgacgcgtggcctgcgtcaacggtcggtaggggcaccggactgtccggtgcgccaactgccccaaagctgcaacggtcgtctgcgccagaataggaaggagatcggcaacggaccgtctatagtgactgtccggtggcgcactggactgtccggtgcgccactcgacagaaggcaaggatagccttccttgttggcctccaacggctcctagctgccttagggctataaaagggacccctaggcgcatggaggagtcacccaagcttccaagaaacattctaagactccaagactccaacttcgcgcatttgattctttgagatagtgacttgagctccatttgagttgtgaactccgtgggtcgtgttttgagctcaagttgtgacttgtgtgcgtgattgtgctgtgatttgagtcttgtgtgtgttgctctcccctcccttacttctgtgcttcttttgtgatcatcattgtaagggcgagaggctccaaaagttatggagattcctcgcaaacgggagaaagactaagaaaggaaaaaccgtggtattcaagttgatcatcggatcacttgaaaggggttgagtgcaaccctcgtccattgggacgccacaacgtggaagtaggcaagtgttacttggccgatcctcgggataaaaatcacgtgtctcttgtgtgctttctctttgattgtctgtgttcacaagagctcgtttcaagctacttagccgttctaactttaataactaagttttgtggctattagtgttgaattttacatgatcacctattcacccccctctaggtgctctcaattggtatcggagccgttctcttcacgtaagggactaatcgcccaaagag

SEQ ID NO: 13910 - DNA, 370 bp, Zea mays
gcagcctgactttttagccataaagaagaggattgaggatctcattacaagggactacttggagcgcgacaaggacaacgctaatacgtacaaataccttgcctgattggtggtcagtggcaaaagtccaaaacagctcccagactagtgcaataccacgggggtggcgatctcctgcaaggtggtggtgcgtcaacttttaccatgatttgaggtgcgttatggtgatttgcgtgcttatgggtcctgccacagcaagggctgctcacattttgtacattggtcgttaaataggataagcgtgttggcctacattagatataatgatgattgatgatatgaggaataggagaggcattcaagtacttgt

SEQ ID NO: 13911 - DNA, 694 bp, Zea mays
gcagcctgactttttagccataaagaagaggattgaggatctcattacaagggactacttggagcgcgacaaggacaacgctaatacgtacaaataccttgcctgattggtggtcagtggcaaaagtccaaaacagctcccagactagtgcaataccacgggggtggcgatctcctgcaaggtggtggtgcgtcaacttttaccatgatttgaggtgcgttatggtgatttgcgtgcttatgggtcctgccacagcaagggctgctcacattttgtacattggtcgttaaataggataagcgtgttggcctacattagatataatgatgattgatgatatgaggaataggagaggcattcaagtacttgtatgtgtcttctatgccaatgctttatctatatagctgtatcaatgtttcagttaactgagatgagattatgcttgggggttgctttgctatatgaaatgagtggatactatgcgaatttgcagtatcggtttgtatctgaatgcacctgcttttgttttataggtagatgcgtattctggctccgttgtcacctgttggtttgtggaggcagagtggattggtcagctagctgacggaagtcactgactcactagaagctattaagtggttttgtacttactgagtcaaatatatgtcatacgttgaaaccatgtttcgtaatt

SEQ ID NO: 13912 - DNA, 1500 bp, Zea mays
atacaagatttatttcaacaaccctagccttccagcagtctgtcgaaacgtgcggcagcacgtgtcgaaggacgactatagatgtccagcaagtttgaagtccggagtccgacctgaagcacgtttttttagctagtacgagctcgatgtgctggttcggcacggtccgttgaacgcatggtccggtttttttttactaaaccgtgcttttcgatccattgaatccttcttttgccgtgcttacgggccgatgcggctcgtttaaggttgtagcatgccgggccgttcaaagaacaagctcgcgagcctgtcaggctcggtctgattttctaataatgcctgatggactgagcccaaaaccaagccgggctggactgcccgtttgaacatgagtacggacgaccccgacgccaaaaggtgactacaaaggcgagtggagcctcgtgcatgcgcgcgggtgaccttggccagctgggcctgagccccaccgtacccactacccagccgtccgtgccattgtgtggcagtagtgccgtaggtcggtcgacgcacggaccacgcacagcacgcgttcgatggtcgagcgcccgtgtagaagctacaaactatagctgcggcgcaccagacgatgaagcagctggacgcgagtcgagtcgagaccacgatctgcttgtgttgtgcacgccagcagagcatgtgttagacgatgggtcgctctccgagctagctcggcaacgcgcatatatagctagctagataggtcgccaccgtgcatggcggcgcgcctttacgctcgctagctcgctgccggtcggtggtggcgtgcgtgcgttgcgtacccgcgcatgtgcatgcgtgtgcgatcgaggacctccgatcgtcggcatctagctaggtcacaagtcgcagccagtcaccgattagatagatccccgcctcccctggcattcatcggcctgccggccggccgtccgcagtccatgcatggcgcggcgcggggatggtcctggtcctgcggtcctgccgcccgcgctgcgctccggcggtgccttgcgcgtgcgcgtctccgccgcatgtgggtttggtggactcgtgtgcacgggcgctcgctcatcgagtagacgagtacgatcggagacgacgtcgagacactgtgcggctcgtgtgctcgacagggacgtgccatccgacgagcacgtacgtctgagattatattgtccgggcaggtttcccaagttgcatgtatatatgcatgtggacgcgcatgcagtgcaggaaaggaaaacgaaaagggcgcgcccacacacacctactgggctagctagctagccgcgccaataactcttggctggtggatcacagacagacagcgtacgtacgtacgtgtacgtatatgatccacgtattgtgctgtgctgtgcccccacatattgtgctagctagctcacgtattgtgctgtgctgtgcccccacatgatgcacatatatgtgtagcccata

SEQ ID NO: 13913 - DNA, 1406 bp, Zea mays
caaacataaacacatgggaggattaacttatgttcttgtttgaatacggttgaaatttgatctagagttgaaaaggagatgcatggatggcttgccatgagtttagtgggctaaaatctataggaaagtgaccgaataaattagatatttgcaatatattgcatgccatcacatgatatatcattagtttgcatgacaaatactacttgatatcttgtttgctatagttagcacaacaaattcatattatcatgattggtcctgatacgctatattcgcatttacacctaagattaacactaaatcaaccacatgcaatatttttcataattcatatgttataaatgactacacatcctatcctcactttttattcgtggctacttgagaaattaaaccttgtggatattataattccattttttcctacatggttatgatcatatgtttctatattgaaaattatcagtattagaacaatgatgtattatcattgcatcacttcaaattataaccttacatattcaaaaccttgcgagtgaggtctcctatcgatctctcaatagccactacactacaaagatacactgctgcagaaaagatatcctgagttgataaaaaaataatttctagtgacggtttctaaaatcgatagcacgccatcgattataaaggtgtgggttatgcgatgtctggctttgagtagcccacacatatatttttccaaggacggctacaacaataatattatatttgcaaatccacttttaagagtggttagccatatctagagttctatttttaaggatggttgaactaagaaaaccgtctctagcgatccatttctatggacggtttagaaaaccgtccatagaaatcaatttacaaggccggttgaattaagaaaaccacctctggaaaacgatttgcatggccgggggagattgagtgcaccgctgctcctcgttctaattagcgacggtttcttattagatgacaaatatcttttaagaaatctcggagccgttcgtaagaaaaaatattgtgcagtagtgataggtggacagagggcgagggacagcatggtcgtctagcgtgtgtcyaaaggtgtttcgtgtgtacaagggtgaccttttccctttctctctctctctcgtcttcagttaaagccatcagcacatggaattcctgtccccaaatctttattaattacatcccccataaccccccttctctccttcctcctcttctcttcctctcgatctcgtttctctccaggctcggacggcacagcgcgcggcggcgtggatcccgtctccctctcctcgatccagccctctgaaccacatgcatgtgatcatgcacgggctggtatggtaaagggcgcgccgtgctgctagactcgt

SEQ ID NO: 13914 - DNA, 384 bp, Zea mays
agtatgttctctctaattcttagtcttgtttacacatcatcttggaatattatttcaactttttcactcaagggcagaacacagtgtccacatgtattccgaggttctcaagccttttgaatgcactgtgttttagtagctcaatattcttgttttttttggggacatccgtttctctgaagcttattggccacatagggtgataggcacatggcttatgtagacacgctatcgaaaataatcctgttgctccatcatgcagtgatcaggaaaggcagcttcgcaaagtacgactatggatggtggggaaacctaaggcgctacggccagctgcgtcctccctcattcgatctaagcagcataccggaatcactgccgatatgg

SEQ ID NO: 13915 - DNA, 580 bp, Zea mays
gcccattaacaaacccatgaatataaaattgatctaaatccatcccataatagggtaaaaacccatagagttgtccccactccgatgcctgtcggccggtttaggccagcgtgaaggtccaacgacgctcatactctaaaactagcactgccctcaatggctggaaataaaactataaataaaatatatagttgcgcacacactgtcaagaaatacgtcgataatgtttcgttgacgatggaaccaatgtcaaatttctcacttgtcagccgtcagaagtattgccagctgaccaaaaaataaaattggttgccgccctgccggcatgtgatgttgccgatttcttggatcctcgtgcaagcaataaaagccctctagattgttccaacagtctgtaaaaaaataagcgttcgagctgcatgctagaagtcaatcaaagcaagcaaaagagttggcatctcagcagcagcagaggatgctctgcgttttttttttcatatataagaagatagactccccggcacatccctccgcagagaattaagccaacggaaaaaaaaagaagagagctactacagca

SEQ ID NO: 13916 - DNA, 227 bp, Zea mays
tgaaacaggacattgcagtaagccacaattctattttagcttttcagatcaagaagtttttaccatcaaaaggatcaggctttagcacagcagcaaaacctctgacagaaaaatacctaacattaggtttttggattgttagaattataggcattttccatatcattttaattccataaattaacattatgatgatgacatataaaagataattaatcatagaaatc

SEQ ID NO: 13917 - DNA, 1500 bp, Zea mays
gttaccacggatcaccagatccgctcccttcccttccatcagcagtaaaggcgcaagaagatgtagagaacccgtctccttcccataagcacgacagatgaaacacacgagacactggatatagggttgggcctctggcctctttctgatctctattccatatgaggggtacaagctctatatatagagacgcgatagccctcagggctatattcggtatttgcccacataacccttcattagcgtttctcaacacttaaatccctctcagtctctccttcctctcccattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtaagtttgccgcgctggttgagctcgaccaggccctcctgctaccttcctcgcattgggctgggggggtgctccggagacggttttgccctgcaataggcttcacctgcataagtttgtttcggtttttgcgtgaattatcgaggtggttttggcttgtgcgtttggtttcgttcgtttgggggttggccgtgcctgggtttggattcggaacgcggtgcgtgttgatgctggggggccgaatctacatgctacatgccctattaaacggctgtcactagtcccgatccccgatcccatcggctcctagcagaggcgcaccaggtcccactgccaccgaagcacaaacgcaccttgccggcagacgctcggacaaatgttaaaatgcactgtcgcacaggtgcacatgctagccagggaagtggatccaagcccacacggtcctggacaaatatactaatacaggcgggaggaaaggaaccccactgtacctcaaacgatcggacagagtgaacgcgccacccgccccggcgagcattgtccgatgccgcgcgccaccttccgctcacgggttagctttcttcctcccctttacgtccgaaatcgtttgcccgtcggccttgcagaaaatcgtttctccgcccctggatactggagacccaagccgttcttgatttcttcgtccccgatccgtccagctctctgacgattccttcgcctgcctgcctgcctgagcgccaatgcagtttagcgcttttcccaaattttcttcgatgctgacatgtttgcttccacactgttttgtccgcatctttagaatccttttgttttctgctgtgcattgctgccagccggctaccagcctaccactcgcccagtcgccatcacttttctcccttttttctttgtttttttgtgggcctgtccacgtacatatcgttggcgtggatcggaatcttgaagagacgggtggagtggagactctggtctctgacatgcagcaattattgcaggtgcatttgatccgtcccggccgcctacacg

SEQ ID NO: 13918 - DNA, 1310 bp, Zea mays
ttacatctactccttgaaaaatgtggagttgggggggtaaacaccaccattttagtggagcaacaaaaagagtactctataaaacttatttctagatgtagatgtggagttcgaggttaattacccaccaatgccacttgttatagagaaaaaaattcatttttccccctttgttcttcctctagtcgcgctgatctcctcgccatgatataccaatggtgccgctcccctcttccctcctgccctagctctagcgccgcgagtgtccacatgcacgattgtgccacgatcgagtgacaggtgtatgtagtttactgatgaagtagaggatgatgcggtagttggagaagcgccctgtggcacgacgaaaggtatcgccatatggttacaagagtgtgggctcgctagagttgtttccggtgtcagccagcgagtccccaaagctgaacatgcacgggtagcatgccaccaccagctccgcccccaactattaccattaccgccacaaccggtcagttgtcttcttcctaacgaccacacccacgctcgctcttctagctccactcccaacgcacgctcttctagctccggtcccaccgcacgttggctgccaatggcctcccgctctccacgtcggctatggctacaccgctgccacaatctagcgacccgcgtcggggacatgctcaatgccgtcgtgtagagcgccttcacgaggctcgttacatgatcaattccgtgatgggttagggtaacaaatataatttcgaatgcaatctcaaatttctagacgtagagctacattacaaaccaaatacatcaaaatatcgtaaaactatggagtagaattgctctatagtgtagttagtggagtagagctggaattggtggagtcctaaacaaccattattagcgaggacgttcagtttgctaaaaaaagcaccgacatttaggcgcagaaaaaaaaggtgttcatgggttcactctcacagcccacgcaggaggcaccgaacattctagccctctgtggtgtcaacggcaaggcaaagcgaagccatcaagttcgccgtccaaaccagctgaccacagcagcagctctccatcggacggcagagagcagccgttcgccacttggattcaaacgccccgtcactctaaccgctgctgaaactaccaaattacccctagccccctccctcagtctccctgcagctgctccgtcggaacggacaaccgcggccatcccccagccccccctcttgctgcacactcgcactgctagggttcgctcgcaatccagcctctacgcc

SEQ ID NO: 13919 - DNA, 1500 bp, Zea mays
tttgttttcgtttgttatgggaagaagcttgtagcggcgaaatggcgccaaccagtgccccgtgcgcgcgccagattgggaattgcgaatcgagcaggagcagttgattgagcctgattgctcccaaaataaacatgccctttctatgggccgacaacccatgtacagtaacgggcgtgggccgtgtggcctcagggctcaggccctcgctcaactattgaacaaatctgattcgcctcactcagctgaaaaactattttaattttaaagctgtccgcagtagtataaaatagagaatttatacatgatctagtatatagatccatctaataatatgtgttgtttgtttaactcttaatatattcaaattgaattatataatttaggggtaaacaaacaagcctaagttttgaaacgtttgaatcacctctataggcggttttggaagcggatttgactaacgtagcgtcaaatcagtcgctccacatggcgctaggttgtatatcaagccaactcagctcgactcggctcgttaagctaatgagccacagagtcagctcaattcggctcgtttacgagctcgaactaacttgtttagctcgcgagctacagcgggaaaaaaaataatatgtatataataatcaatttatagttaactttaaactaatttaataatagaaaatagtaattatatcagtagtttcacataccacatcaatgtacacaccaaattaatacaactcatcactcatgatttcacaattcacactcatattaatcagtttaacccacaaatatattcatatagactaatttaacatatagacacaattcatcaatcattaatttaacttatatgccatacacacgacacatacaaataacatgttaatcaattgttaygtaaatgatatacatatagtttcattttgctaaaatgtgatagatcgtttagctcacgagctgactcgttaacgaaccgaactaggggtgtttggtttttagagactaattttaatgcctttattttaatttattctattatagtctctaaattgcaggataatttagagactaaaataaaataaaatggtgagactacaaattagtcaatataaattaagcaccctaaataatttagagactaaaatataataaaatagagagactaaaactttatttttagaaatcaaacatcttctataatgtcgaccctgctgtaaaaaaaaaaaaaaaatcaaacgacccaccataaaccgaggtagccacgagcacgtctggccctactcccccattctcttgtttgctggcccggttggaacaccgcctccgcctatatagagctccccatctccgactccctcttacccttcccgttccccaattcgaaatcgagtcgggtactcgggtcggtcttgccgtgcgtgcgtggctgcgcgaaccagcccacgctcccactccccgcccgccaccgccgggtccctctagggttttgccgcg

SEQ ID NO: 13920 - DNA, 216 bp, Zea mays
atcgacatgtgtcccctcatttcaaggtactagctggtggcgctagctggtctcacactctcactagatctctctcacatgcatatgcatgcattagcttttccccaccagcatgcactagctgactagcatctgtgtaatcggtgaccgctcttgacttgttagctccccgctcccacggtagctaaagctagctaggtgggtggtagcaccacc

SEQ ID NO: 13921 - DNA, 54 bp, Zea mays
tgtaagttggccacctgaactagcgacttctgaaacttgtcaaccatattgatc

SEQ ID NO: 13922 - DNA, 1286 bp, Zea mays
tttggaagtccagtcgggcgatgttcgtttccaattaaaatcctaagttttgtttgaaatgttgtagccgataatttataaagacaaaagtaacgtaaaatagtagaaaccggtatagcctgccgactccggtgtcgtatttacgtacttaggcgggcgcaggcatggatgaagggaggcagcgctgcaacatgcatgggcatgggtactcccctgcccctggaacaggggtctcctcaggctcagcgcgacgtgaaaggaccggcatctggtacagtaactacgcgtactacgcgagagtgtagctgtgggcccggctcgtcgtcgtcgggcatgcgtatgcacagtagcttctcacgtgccattgccgtcccgtccacacctcaccccaccatgtggcgtttccgatcggcagtcggctctgctctgcctctgctacaccaccactggaggtctggagcgccaggcaggcacatgcttccagcgcagcatggcagagatgggctggtcaatgcagtgccacccttgcctcgccccgactgccgtcgtcggtcggtcggcgaccctgtccgtccgcggctcgtgctctgctgcaccacccaactgaaagcgcaggtcatttttttttccccaatcattgcggacatttgttatcgccagcatcagagtacctgacaagacataagactacacgtacttgtacttcctacgaaccatgaccacgaccaactattacggatactgaaggctgctgctataccgtacgtactactgacagcaaggtgccaacaccaagacacgacagtcagaacgccgagaccgtcaaaaccgtactcgcctgcacaagttcaaagcatgggctaaattattactattattattattatagacgaactgggcttaatacgaagagttgtcacgtcaattagctactgtttgtatgattagtttcatgatattttcaattaattcttctaaaatctgcatgtaaaacccgtgtgctagttatccaaaacactgctgctttatttacatgccaaatcaaccggccagacgacgattaaccgtcggctagctgctactactacgtactactagctagcggtggtgtaaaccaactgccttaaccgcgagcattgcccaaggaaaccaactcgtggcgcggcgaccgacggacgggtcactgggcgccggggcccacgtccttctttgcggccctgttcttcttggccgcgccggcggaggaggaggcagcgcccgacgacgacggggcgaagaggcggtcg

SEQ ID NO: 13923 - DNA, 435 bp, Zea mays
gcttttctggtgtaaggtcgtatgatcaagcgtgctctgaattagtcagtggagcatgatatactaggtcgattcatgcttattgctgcatagttaatttctcgttgtaatgcaccagtatgtaattgtatcattctgtttcctgattaacttcataagttaatagcacttgatctctcaatgaatttcatgctgcaaaccaaagcatatactggttggttagtgtttcaggttttctgtacattttttctagctttcgatcagatgtacccattctattaaggacaaacactgcaatcatgctaaacttcttgcctgagaatttgaaaatgatttgtttgcttctccttttgattcggtgctactttttgtcatctaggtgataaaaagctgttgactccgcaacctcggctaaggacaggatttttctcagtt

SEQ ID NO: 13924 - DNA, 1500 bp, Zea mays
atcatcggtcgtcgcggggtcagcgaaagatctcgtgcccgaatcgggcgggcggcgcgcgcaacacgcggccaggcgaggcgacgaatcgatcacccgtcgacgacgaatcggagaggatcaaagcgggcgcggctgccggtgccggccggtgaacgcagtgtcagtcgcatcaacggagaaaaggagtgaccgcctaattgagcaccgccgctcgtagtggtagactggtagtaacaggtggtgttgacgcaacagcaacgcacccggccagtccggtcgtcgagccgagccggctgggcacagtcgcacagagaagtatctcgcttcgtgtggcctccaggccgggctcgccgcggggaatctccctcgtgccacgcgtggtaggagcgccggtcggtgttcttcagccggggcggtggcatgcccatgtcagcctgctgctgcgtcggcttccgatcctgtacgtacgctcccgcgtttcagggaggttcgtaaacccaggtgcaaaattgcaggtttccgttcgtatatatatcctacgaatattcttacaaacacacctatgtacctatgcattcttgtgggtcattgctgacactatttgaatattctcgctgcctttagataactaattaaatgttatctcctttccgataagttggcacgtacaggacgcgacggataaacaagcatatcaacgcttccgcggatatgttttattacaattgctgaataccaacccaaaaaaaatagaaattatgatctcactattcatacgtcttaaaaagaccctacaacaaaagcacattccagaacgggccgttcatgtcgttaccagaaagcggaggaatggatatgccagcctgaggggcctatcctgtccgtcaacacacgagggagaagccgcgtgcgtgcctgtgccgtccgtccagtgatccagtccgtgcccgcccaacacacaacacaacccagacccagggaatgttgctgtgcaagcgacgggcaccgcgcttgttgactcggcttcccctgctcccacggctctccctcccacctcatcttcctcctcctctcctcctccatctcctttaaaagctccgtccaagctttcacctcgcttcaaaccacaattcacaggccctctccgatactcttccttcctcggtccaccttttttttcccggccctctatctccttagctgccaagaacacgctgttcgatcgtctcgtgctagcgtggtagtctggaagcgtctctttttttttcttcttcctgttcgatccagttctacccgtccaatccaatccaagctcctcccttcaccccaaagggacgagagagagagagagaggtcctctatggccgggcctgctgtccaccctcgtcacggcagccggccggcgctctgaactcccgagccggctctccatcagccacgtcgcgcgccgcccaggagaaggagctctttaatctgtgctagcagcggtcccagaga

SEQ ID NO: 13925 - DNA, 682 bp, Zea mays
ctgtttttttctatgattataaaaaaactcaaccggggtcctcccagtatattatattaagaagagaccgaaacaatggttccggccgagaaaatccccgaacccttgccatcactaacgggccggcgtcaaccatccactctgcattggtccaaccggagggtggcacacaagacatcgtaacccgagagtggataagacatagcgaggggatttttttaaccaagtaaaaaaaatttttgcccccgaggggaatcaaacccatgtcttggaggtgctactcggaaacctttaaccactaggcttgaggatcttccgttttttctctgattgtagccaaatacaactagccgagacgtaaatcaagcgccctttatgatgctaacaaatagccaatccaactaattgatcaaagccttttgttagaattttctcattagttgtgatagttggacgacaaatttgtatctgctgcacctatatcagcaaaaatcaatagtttcaattattcatgatctgttatgctatgaactgtttgactaaaccatatttttgcagattagtgatgaaggtggtggaataccaaggagtgggctctcaagaatttttacgtatctctatagtacagcagaaaaccctcctgatctggacggacataatgaaggagtaactatggctggat

SEQ ID NO: 13926 - DNA, 828 bp, Zea mays
gtcggtttgtgatgaaaatgtgtgtcgcttttttaaaagctgtatttaagaatcgaatttttattttatgttctcgaataaaatataactcgagaaagctttacttttatttcttggtagaaaaagtttattttgttaccagataggtcatttgggcaagtaccaaggggctagccactaaataattaccaatatgtggtaataataattttaagaatcaaaattaggtcttgcggcttgtgtcgcactagttcggatcaacatgtatttgttgataaaaaatttgaatccgaaattgagtcaaataatattatttaaattgttgtagtatgaattttagtctagatgtgtcataatctgaaaatcaaaccttggagtgtttattgcattaaaatgtatatcggcaaggaggttatataataattaagtatatataaaaaaaaagaagaatggagataacgttattgcttcttggaaatatctcatgtacgattcttgggtttaacgttcaattccctgaaagtttctatacgtctcctcctttgtcccaatcgacgctggctcctagggatattcttcaccgccctcctctcttcttatctccagccgttcctatcctgtccacttcctagaaaattcctagccgctcgtgcaatctccggcacgcagccttggacatcgcctcatctcctcagctgctcgccctgtctacgcgccaggcgacgtaaccagtagcctctgctcgctggcgtcgtgctcctctgctgaattcgacgctccgctgtcctgcgagctcaaccgcgccgaactgccaagccagtggccgac

SEQ ID NO: 13927 - DNA, 1324 bp, Zea mays
tattttatattatccaaaatcatataaaaaagatagttatacactgtacttwtgccatagaraagtaagtagaataatgtgttataaggtgtacattagaaaagtatcatataaatctatagaatcaatttccatcttccatccttcgaatttaagatatgcttatatataaactttagaaagttatgaaatatcatatttaaaaaaataggacggaagctttaaatcacatcctccgctccatgttgtgtggtgtcatgcatgtgcctaggaaatcacttagggcactcatttgcaacgcgagaactaggttcctgtattttttatgtataatttctgtgacccgtttcaaaggggtcttaaccttttcttttacgagcaaggtcacctcacatgactcgtgacaaatgaacaaggaacatcttatctcgtgtgtcaaattgcagcgctcaatgtctgatacgtctgttgtccatatgagaggaggttaaccattgtcatctacgtcgggtcaccaccgattgaatttatccaggaatagattcagatatttatttggatactgattttttacttctttttctattacgaataaataaaatacaaaatttactacgtaaatctgtgttcttatttttagtattgaacttattaagattcataaaaagtaaatcttaaatgtatactatactttttaaatgattagatataaaattctggtatgtataaagattcagactaattttcatcttttcattgtagtgagcaaaaatacataaaataattttatttttataaaatatttaataacgtagattgacatcaaattatatacatgtctattttagattattaaatttcacctaataattccatgtctagatccatgcttccattcatccatccaccgcccataacctggtggcccactggaccctcactacgaatagtacgaactccccagccccgccgcgccagctcagcggcgagccgggttcgggcgagatattttccgacagcccccaccgccgccgctgccgcccggggccgacctgccacctcacctacggctgacacgtggggagcgggaggtatccgctgttctgcggcgcgtggtgagtcggtccccgcctccgcctcgttgctgcttattgcgaagtcgcgagcaagcgaacgctcgcctctcgccatttttactcgtcggctggtccggccccagcgattcggtttggtgcgcctcgtggtccacgtgcgcgggctttgtgctctctcttccctctgtgtgtgtgtcagttcgtcgggtaggttggtggcggcgtgagag

SEQ ID NO: 13928 - DNA, 877 bp, Zea mays
tgtaagaggtttgtgttggagcaccgggctggcgagaaccgtgctccaatcatttcagatgatagccccaacaaagatatcaacaatgccttctataatatcgtgatgatgaaaaagtagatactactaccccaatatatcttatatttctcttctttatttccttttcagttttagtagaagaaaatgttgttggcttgtgatttagcatggttcttggattctaaaaagcgattgtcttcaccaatcctttgattaattctatgagaatgcttaattgcaagacatgcaatgatgtaattcttgctccaatcctaatgaaccagttgttcacaataggctaaaccatcagaaagttaactactaactacaatcaaactattttttacgaagcaattattattttgttacaactttcaatacagaagacaaaacacatgaaatttgataaatgtaatcctcacatttgaaccatagtattgcagtaccacaagaatagtttcattttatctgcaaagtcattccttatatttgtcaatgaactatcatgcaaagatagaataagaactttgtgattgcttgtttatttatgagattgaataagagtgttactacaaaatatttgtcatatcttttcaattttctttcttgtgtaatcatggcctagatgtttaaattactgattagcagtttttctatgcattattttgagtttgtagacaacagacatgagtgtcttttgttattaattttcaggtcaaaggtcggttttgtggaaaacatacaatatgttggtatcttcaataatacaagatcatgtaccacacatcgacatcaatattgactaatttctttcaataggatgggagaatgttga

SEQ ID NO: 13929 - DNA, 613 bp, Zea mays
agttaactggggagacgacggcctccgaaggaatgcaaacctcagtttgttgacgcccaatgcaagtgactaatgttgtggggatggacatgcatattatgttggaggagtatggcctaaaaaaagccttgtgcatcagtatcacaagtcctacatgtcatgacccgtggagaacacaaacgaatgagacaagctaagttggttggtactgctgcgcaacaagaaaatatctcatcctcttagatttcagtggtctatagagacgtggggctccacaagaaacttcttagctgatggtgacttggttatcgaaagcaactccaatcatatgatattatcagtaggtgaaatcatgcctattttttcggaatatttctttgcaaagaaaacttgggtttagctaccagatcgaccattaagcggatggatgtttttaaggaccccgacaccatgtttacaatcatgtttccctgtaattcccttcgcttctagcccttttttttgttatcttatagcatgacacatcaccatgtttatcctaccactataaaagtataaaggcgcacaaagcttccaaagcgaagaagctcttgaggagatactgtaacgaaac

SEQ ID NO: 13930 - DNA, 638 bp, Zea mays
ttaaaagatttggctcctcagaaagatagacgatgtgcatttattttagaaatgataggatatatttaaggcgacatatggaatagacaggttgggatggagtagatatatatagattcatacgactaaagttgtgttcagcagatcatatatatagctatgcaaaacactattttacactgtagatagcaatatttatgttgtttagagagtgaattttgaaataagaggtgagatagagaatgtgatatggcagctaagagctagttttcaacaagtttgtttctataatagtatagctagatagacagacacgtagctaaaatggtcaactgaccttcgtacaaaaaaaaactttaatccagagatatagcaatatatgcttataactccagacctcagagtcaacccacagatttttgtatattcgtcaaaaagatccacagatttgtggtagagagtatgttttagtagtagtggtatatctcccttgtgggacgacgaagcagccggtcagccggcgctccggccggccggccggcctgcgcctgcacagtacaaatagcaccccccgtcctccagttggctgcatccttctagcttcgatctctatatacctctgtatgtgagtgaggcca

SEQ ID NO: 13931 - DNA, 1500 bp, Zea mays
cggcttgtgctgactgctgagtgctgacggtgcaccagcgacgcagctgttgtgctgcggcctgcggctttccacttccagcggtccagcctggggtttttaatgtggtggccagagactgtcgagctgatttgacgattctgatccatcgccacattgtatgtctggtttcatccgagttctacttcgttttctcgcttttaaatcaaattgtgcaatcagcttgcatttatgtaaaccttggttgtttatgctaaagaggcagtttcatctctgtcctttcttcgtgcagtctacgttacgtacttcttgttaacgaaaggattgtcgaggtttcagaatcatcgctatgtataatgtattgacgtatgtttttctttcttwaattcttttcactatgactgacaaataagcgctctgtaaccatataatcctccctccgaccccctccaaccgaagccttcaacgtaataacacattaaactactacatgcatagtacaaatgaccatctcacttaacaatgtgctgtaacggggtgtacaagaagatccattgtctctaactatatgactagcatagcagtacatggatgcctctttttttgtaaaaaaaaatccatgaaactgaagaaaaaaaaaacatattagcagcacatggaccagaactccaattcccagcttcaagtagatataaaaagttcattccagtttcatagcctcgataattctgtacagtatatttcatgttgatgaaacccaactcttctttccccctttggaaggttcaccagtttcgaaaataaccagtcatataaacgatgatctttaaaacgagtcgaactaaagggggtttggtttctacgaaattatgaagtaaattttagtctctcaattttatttttattttagtttttaaattgttaaatacaaaaactaaaatctattttaatattcgtatttgataatttagatactaaaatttaataaaatataggtattaaaaattggcttatagaaaccaaacacctcctcattattgtaggcttcgatttaatcttttacgtacggtcagttccagttatattaactatgacatagacccctacaactgttaagtgttaatagtaagttttttcagcctaattgctgtgtaccctgtgtccctcgctccctcgcggcctcgccccagtaataataaaataagaaattctcaaaaccaatagatgaacggaacagctaataactgtcgacctttccagctttggcaaccgtccaacacgagtctcttctctcttctccgttccttccctcctgaaattctccgctcacgccaatcgaggcacgcaaatggctgagagcccgagctgagcaaccagccaaagcgagaaatccacttggagaagcttctgcgcctccctcccgaacggaggcgggccggggcggggaggggagcacgcctgcgctctgcgcctgcgggtagggtttctcccggcccgacg

SEQ ID NO: 13932 - DNA, 597 bp, Zea mays
ggtaccattcatggagcttcggtattacagcatgtccgaggatgggggatcgaaccgacttaaagatagaatgaccttttagtccttaagggtctgagtcaatgttgtaaactcttatgaggggcatgattgtaattcttcacaggctgcgtcctgtgcctataaatagtgaacagtatttctttactgttcacgcattctggtaattgcaagtgcatctctcgggaatcattacttgtcaaagcgaaggtataaacgtaccttaaaacattgtattcaaacatcttatattcatatgataaaatatgtgaatgatgccatttatttccgacatttttatctttgatgttttacattttacgttactttatattatctttgtaaatttaattacgaaggtgaaaccttcgtaatattatgttcgtggscttcgtccgaagttcattaaatccttggggagataatgcttcagcggacgaaggacatttgatatttaacattttttgtgttgccttgttcttgattcataacatttgagaacaagtccccaacattggcgcccacctccggtgaactcacttccacttttttgagctg

SEQ ID NO: 13933 - DNA, 180 bp, Zea mays
tcgggtggctcgctagggttctttctttcttttttatcgcgtcgcgcgcgcgattttctggccatgtcgtaccagcctgcccccgtctgactccattcactccccttctggctggctgcttgctgctctgcggcgggcggcctgcgatagccagcttccgcaacagttccacccgacccg

SEQ ID NO: 13934 - DNA, 1500 bp, Zea mays
ggtatacaattgagccagctgatctttttataagcactagcacaatgaaaccataaaaattcaatattaaaataaatatatggtccatagatattaaattaataataataaatattacaatttatcttagtcagagaccgaaaatatatgagttaaaaataagtctaatctctttttttatagcttgttcgcgcactcgatttccttcagctagagagacggtactatatgggatagctcgctcgatagcccaacctccttcagctgtcgaggtggtactatgtgtgagtgttgtgctacatgcggtttcttgccgtgttggacttgggtcatttctcaaccgatttgtagggcaacgggccactaataggggtttaggtggttttcacggtctatctatgggggacgacccactagtaggggaggagaatagacctatgtgtgaagcgtatgatgcaggatgaccattgaaactggtgttttataataatagagactagtataatgctcatacgttacaatgacacacaatggtgtgtggcctaatctttgtagaaaacgaaaaagagagggagaacgcgcacgaatgtgcagtagatctagacttcttttttcacaaagcaagttgaccagtagatccacactatgtataaggcatcatatgctttcgttcttgatatagatcgataattataaagaaaatggaccttgttccatttgaccatatgattttggtgtttgatgatcaacaaaaccttatatacaaatgtgtttgctagtgtttatatttatagttcacatgatgcaaaagtgacttagactgagacattaaggaagcaacacctcagacatttgaagactcaaattgtcggcgtttcgagaccggggggtccctggaccgacgagtgaaatgtcgtcgcatgccccagcccagatgggtcggcgcgagacggagcacgaaggaggaaccaaaggaaggagacaggcaaaaaggggaaacccgtggccttcgtgttgtcctgcgcccaggtcgggtgcgcttgcagtagggagttacaagcgtccgcgtgggagagagcgagggactctacgcgtcgtcccgtcttcccgcgcggccaaccctctgtaagagggccctggtccttccttttataggcgtaaggagaggatccaggtgtacaatgggggtgtagcagagtgctaacgtgtctagcggaggagagctagcaccctaagtacatgccatcgtggcagccggagaggttttggcacccggttcgtgtggtgtcgtggccgtcggaggagcgctggagtctggcggaaggacagctgtcggggctgtcgagtccttgctgatgtactcttgcttccgtaagggggctgagagctgccgtcgtcacagagcgtgcggggcgccatcattgcttatctggcggagcgagccagatgggacgccggtcttgttccccgtagcctgagtcagcttggggtagggtaatg

SEQ ID NO: 13935 - DNA, 1500 bp, Zea mays
agcagtggagaggaaaatgatgcacctacctcaagcaggtgaccataaatcgaggcatttttggttcattttagcgtgagctggtttgttgggcagagaaatgaggatgatctatggagtaagaatccggttgctatttcttgtccatagatttacttctattttttatgtccaccaaaccagctctaaacatcgtcttttgccaccgaggagctaaaaagcgcagatcacataaataatctcctaacgacccttcgttgaagagttttggagccatgcatgtgggcgtgccgggacgtttgattattgccctgtgatgtgagagttgcctttgggcctcgcctctactgtacgtctgtaccacccgaacaaatcaccgcaaccacgttgaccattttcattctcctctactactgggaactttggaaacatcccaacaatgttgtcttccgagagctctatccaaacatcccacggtacatatgctggcaggttgccggtgaaacattgagattcggagtatttgacgttatttgtttagagtatctccaagagactagctaaatagtttgtcaagctaaattttagctacttaatagtaaaatagctctccaacagactagttatttaacttgacaagctatccgactctctaaattgactccctcactagccaagctaacttgcatgttgaagagtctgttggaatgagatgctatatttatagtttaatctttataaagtgacaaataaagagtaaaaaataaagagtgtttttgagatgctcttaggagtagtttggaagtcacaatttcgaataagaatagaattctaactcattcagcctctttggattttgtaggtcctaaactagcatagagtcttctgctctcttccccaacaattttaaccaaaactgaaagcatcctctgtcgggcttcttgcattggtcaggccggcccacaaaggccttttctcctcacagtctcacactcgagactcgaccgacgcccccccccccgccgtgcgttttcacccttgcttttcttctcccgctctctcctcgtgcgcgcgcgcgtcgtctctcctctctcgtgccgacacctgcgcgaccgctgccccgccgccgctctacgctgggtaccgaggtctccgcagggcgcttcgcggcgacgagcaccaccaccaggcatgctcccatcgcttctcttccttcccgccgcgcgagaccgaccggccgcccggagccctagacgttcggccgtttgattcgtatctgaatgtgtgtatacacgagtagccatgcgtgctaccaagtacccatgcccattagttatacacgagtaccatgcgtgctaccaagtacccatgcccattagttagttaccgaacgcccgaatccttcggcttgttccaaggattttcgtttgggatcgcgtgctttgtttcaaggaacagaacttgcattgttgctaacaacaactgcgttccactgccagg

SEQ ID NO: 13936 - DNA, 175 bp, Zea mays
gcagagttatatatggctcggattatgtgtttacatggagtacaaagaagatcgtgtctgatcgaggttcacagtttacctcagattttggaaaagtttcatgagatatggatacgaggttgaatctagttggcttacatcctcagactggtgacagactaaaaggactatcagt

SEQ ID NO: 13937 - DNA, 1500 bp, Zea mays
acgacaaagacagacaatctattattatacggagtagtacatgctattcgtatctgcaagaaacggacattggtactatgatatgtttttatgtggggttgtcataaatgaygagaaagataaacaaatctatgcgagggatgccggtggttgctcaatgatgcttttttggggtcatctaactaattagggatgaatgtcattctagtttagttttttcctcactcaactgacgtaaagtactcattgattttttgggccgatctcagtgacttgaagtagttagaacctacatttctaatatctcactacaccactatgcagagtgcgagtatagtttttacgtctaacaaatcagtatttttattgagacagtgttcaaaattttatacatacggttatccaaagctctattttgtattgtatattgtactgtttgtagagtgaagtttgacttatatgtacgtaaaccggatcacacgaaaaacaggatatttcattgaaggaaaaaagggctaaaccaacaaaaaaaaaaaaactgcctatacgtctccaactccattgtatgtgcatccggctatccgcccattattatccacagatgccagatcacaggaagcaatcttgagctacacgcctaccctcattgtccatccttgacccataggtgggagccccggcctcctcccactgtcggctcctcctcgcctccaacggcgccctcccggtggccacaatgtaaaattaatcttttttcattataattagcaggtaataatatgtgttgcgttactacaaatatggtactacctctcgattccctagtttattaaacgcgacaaataaaaaaattgaatagaatagtattttttaaaactctaaaaattgatatataaaagacaaataccttagttaaagagtaaaagagagttaaatagaaaaaatagttagacagaagaaaaaaatagggaaagaataaatgaggagtatttgagagggggaatggtttgtctcctctcactctcttcagagtctcggcctcccctaccggcaagcacaggcttttctttttctttctcgcccttttttcgccctcattgtgtgtgtgtgcagcacatataatccgctctctctcccccggtttctcttgtcttcttgctgcggcgatggaccaagaaacctcacgggaaccccactccttgaggagccgtccagtgccgcattagtgggttccattcttctttggatcgctgctcgcgatcgcattgcccgcgtttcttttggccgtcttggttcggtcttgattcttggacgaggtgggatttggagagccgagagcggcgcggcagaggcgggtttctcggtaaatctcggttctcgatgagttattgagttggggttttgatgttgggaagcgctagattaatgtttccgtgagtaattcctttcgtacggttgcatttgttgatgtttaggtcgggctagattgtttccatcgag

SEQ ID NO: 13938 - DNA, 1500 bp, Zea mays
gcgcgcgcggtcaccgtcgtgtcctgcactcctgctgctatagccctggaaggctggaatggggctcacggccgcatgaaaacgtgcaatgctcgatttttgacctggcagaaatgccatatcgttgggtcacaatcacaagtagcgccaaaagctacagcagatctccccaaattcttcccttgcgattcagtgctccgcgtagcactgcccccttcgtcgactggaagttagtatatgctctagtttcggccttgcaggtgcaccgtaatcgcgtgtgcattgcatattggtcaggtctggtctttggccacttggacagaggacgcagcagcgcaagatttccaagaagatcaagcgtaatttctcctatggcagtcaggtcattccctacgcaagagcgtaatgcatgcggccagaccggaatcttcagcagaccgggggtgcatttgcatttccatccacctcaagtcccacaccatttccatgaaacaaacgggccccttttcatgagaagcttccgcgtgtcttgtcatccggtgacgagggacgaggagcttgactgcaacagcagtgcctcgtctgtctctgggaataatacaagagagcaatgtgtcgtgtaggcatcagttaaaccctacagaaaaatcgactactttacacttctgttttgaccatccgatccgatataacaaagacgacgctacgctgatcaagcgtgaaaagccgttacgacagtatatatatatgacaagattcttctaagccgtagtggataaaacatttttttccctcttttcgcttagatgatctgatgtagccaagaaactgcgaatcaagtatatgtaaacccattacgattttacgtgtaaaacatagcggattggagtatggcgtttccagtattgcgcgggctactcaacacgaaccgcatgcattaaagggagacagggagaaccaaaacggcaagaaggcaagcctgcactgcacgtcttggaaacccaagacgattgccgtgctcgcgtgctctgctcctgtccctctgtcctcaccaacccccgtccacccgcgcggcgctcacctatcagtccgacgacggcggcggtcggttgccgcaaagtcgccagctctggcgtagccggcagccaccgtatggtcagcagtagtccgctccccctccacggctccacctcccggcctccccactccgacttgggagcaccagtcccagtggtcaactctgccccaccttccccacgtccacaccaacccccttcccccacccaccctgcggcctgcgcttgcctatttaaatgccgccccccccccccccccctgctccattcccttccaagaagagcctccgcctccgctggtactcgagctcttctccactccacgtctcctccagacgctcaccacaagtccacaactaccaagtcccctaaacacaatcagaacttcccagctcacccgcgctagttcgtcgcccgtctcgac

SEQ ID NO: 13939 - DNA, 327 bp, Zea mays
ttcagatgttgtttcccagctacccgataagattgttgaggatttcaggagacttaacctgggatagttactcacattgaaggagttactattgatgtggaacctaccttggagcaagaaatctgcaaaggacagactggtgatgctaatatacaagagattaaggatcttattacggaaagtagaggtccagagtttacggaagatgagcaaggcaccatatggttcaaggacaggatatgtgttcctgatattgaaagcctttgtgagactattttaaaagagacccatgactcggattattctattcatcctgggagtactaag

SEQ ID NO: 13940 - DNA, 97 bp, Zea mays
tgtaagtgagctagtcaaattattcaatttcgattcgccactacgtttatccttagttcttcattggttaaatggttacttttatttgcacttgtag

SEQ ID NO: 13941 - DNA, 1500 bp, Zea mays
tataaatcaacccacagtccgtcccaatgttaatctgagtctgtgaagaattgcaagttagcccctgcacttctctgaaattttgcgcgcagtctagagagtagtaaaattagagaatttattctagaaattgatttttaatacaaaaataattccagaaacttgtataatcatattaaattcattttaactccaaattaatttattccagtggcattaattttgttttaatattgtttatcacttagtaaatttgtttagccatgaaacttgaacaaaaattattcacattagttatgctattccaagtacttaataacttcagaaatttataactaaataaatataactccaaatttagtggttcttattcctgtgatctcgttacgcagcgtagaatattatgatgcattttgttctattgattggtgtgatgttaatttttgctatactatgtatgtttgtattagggatggcaacgggtttgaaacccgcgggtagatggttttcaaacccgcctccgcgggtttaatattaaacccgcacccatacccgttacccgcgacgggtacaatatgctacccatacccgcgacccgcgggtgccacaaacccgcgggcacataattatacacatatatttatacatatatcatctatatatacatatatttatacacacatataactatacatatacaaatatgtatatatataatatacacacatataaaattacatatacacacacacacaaatatatatatatatatatatatatatatatatatatatatatatatatatatatatatatatatatataaaatgttaatgtacttctaccgtataaaaaagtggccgtgctccctgcaattttatctagtacagtacagtactgcgcgtacgtagtaacaatgtcgttacttccagttttcactcgacatgcatgtgagcgtttgagcttgtttgcatgctacttataatccgtacatgcgtatctgcctttcaatttcaacagaggttggtcaacgtgtcgaaacaaatctgtcgaaataatgctacacctttttatatatctaattacttcttgttaaaagacgtttgggtttcggacgctctacgcgtttccgcgggcgacaccttatctgcgtgcgacgcgtagagcggacccgaattcatcgttcaatccagcggaatgcaagcagtcgtccgcgtcgaatgcccccatcgaccttcgcccccggcccctcctccccacccaggcaggcaggcagcttccgcctttagggcaaccctagccaaatccccaatcccaccggccaccaccacgtattccttgtcgatgcgactcccgccgcaccctcgctagccacctcctctccgtcgtcgcagcaccgcagctaggccgtggtcgcatcgctacatcctcccaaccgaggcaccacagctactcctcctcttccccccaccgttgccataaggaggcgccagaggaggc

SEQ ID NO: 13942 - DNA, 87 bp, Zea mays
ctgctttattacatgtcctttatagttaatacaactggcaaagcgccgagcagcacagggcacagggcagagcactggcggggcagc

SEQ ID NO: 13943 - DNA, 1500 bp, Zea mays
tgattttgtggtttccaaaccagtcctgaataattgaacgttaaccagtcgttgtcgtctgttgatctgttgtctgagaataattgtttgacccagtctcttctctcggatgtgcctttgactcgttccgacgactmctactgttctacattgacgcgagatgtsttgttcttwtatactccaacacgcacatagggcgctttcttgtctttgaaaccaataattgaagtaatctccaaaggttcagacttcagaggtgctcttggcttcaaggggcggctgggtgagggcagagctctcaactaaatgcccaaaggtacgctttctaggctttttattggagggaaactgaaattccttgatatttcaggctaacttaatgaccgaatttatcgtccaaattttggtttgtcatccctattccccatggcttcttttattacctgcatgcgtgaaggtgttcatgtttcattttttgtgaggtttcattcgtttagttgaagatttgaagaaaatattgtgcgactgaggagctatctgaactagatgaaattaagttctctggcttggttcactgaataatatattgctgcaaaaaaagaacctgcgccggcatagatcagtggtttgctccacctagctgtatttactaacctgaaatcctgaatatgctagcaacatactagtacgtactctgtttccaaacaaagatgcaaccaaacaagtgctttgttttgaaaggcaagcaaagcatcaaacagagggaacagcaaccagatgaacaacacccacatactgtgtgtttgagaaaacatgaagcaatctgacaaataaaggcatgcaacatctcaaaaatgatgcaggcaagcagcattctgagaacagctggccaggctaacactaaattaagtgaacaaacaactgggagcattcacattaaaatattgaatgagttcacaaccagggcattcatatatataattaagcagtcatgctaatggattgaatgagttcaatgtcacattctgagaaccaattagaatgctatggactatgtattttgtggatctgcacttgtgtttttgtctgcagaattcagtgtgaaagatagataaagaacatgtgttctccttgaccttgtcaacgagggaaaaactaaaaggatttctgaccttacaatttcaaatctaaactaacacactctacctccctagaatactactactgtatttatcagtcgggcaccgtaccagagaggcagagaacatccctcactctcagtttccattttgtagctatattctaaggatccctaagggcttgttcggttattttcaatccatatggatttgaggggattgatacggattggaggagattttgacttactagagattaaaacccctcaatctccctcaatttatatggattgagatagaaccgaacaagtcctaatgtggtttctattttctatttaggatatatccagcaaaggacaga

SEQ ID NO: 13944 - DNA, 1315 bp, Zea mays
ggagtctgtttgtttgcgattataatctacctagattatatattccatcttattttaaatttagtgttagttcaaaataaattaaattatataacctggacaattaagctattagcacgcatttggtccaaagaggtcgtagccttacaatttcccttcgcgtggcacttagaacatcttcaatagcgcctcaaatagatgtcttatttttaaatatagggcctaacataaaaaggtaacttcaaaagtgccatattttataaagttttataaaaaaacatagtgcacataccaaagcgttgcaaacgacgacggcaccaaggcatcaagcaaacgaagtacgagccaaacagttagcgaaaaaatggttcccaacgagagatagagggtgccaatttgtttttgtgggtatgaaaaaaaacgaatttcaattacttaactgattaagaactttactattagagcatagaatatttttagaccccgcttcaattgatacctcttttttttatttatagggcactattttagatatgttgttggagacgatcttatatttttcagagagaattcgagacggaactcctacaactacaagctgcagctgcacatgtggaaacgtgtcgcggagctatttcagtattcgcagccaatgatttgctctaccgctcaggtggctggcgcaatgttttctgctacgaaatgccaaagaaagcattcggaaaccgtagcaagcaggcaattgccgacgccaggacacgttggcgtgcttggcaatcagcgtcaacgagcacacgtgagcacgccacgccccccgcacccgcagcaaatccggcgcgcgcctggtcgtccggccccaccagaccaccaccccaccggcccgggcgcccgcggcaccaccagccaaccgcgcgcctccacgtcgcggatcgcgctacgagcccttggctcgacagacgacaggtcagccgcaacagctttctcgttcgattccttccccaccttcactttctcctcctcgtgaagcgagctctccacgcccctgcgattccatttccatcctgtccgctcccaacttcaaaatcaaaacggccgcggcgcagatccacacgcacgggcaggcaggcaggcatacggacaggaccgccgccgcagcagctttcaaatcccggggcggattaccctgcagacggagcccacagcccagcaccgcagcagtccaccgggatctcgccttcgtcgccccgtgtcgcgtcgcgccggtggccgagcctggggacgctagctagagcctactactgtagaccgtagagcc

SEQ ID NO: 13945 - DNA, 1500 bp, Zea mays
cgacaatgggcgtcactatagccacgtctgaggttgcatgtgtacccgtgagtactatgtagccgtgcgactataaagaaggctataaactacatcatattcgatgacacgggttctcatacatgtcaatgtgtcacactcgtcactatggctcatcaaagacatgcatgacatacgacacaatatcttcgacaaaatatgggtaattggacttttattgaacgagatccgttgttcagatagagatgtaacactctcctccattgttatatagaagggagatgcaaagcaacgtagagacatccctctttctcccgtatccttgcttggtaccgtgatgtcacatccggaatacaataaccaaaagattatggaacgttacactatacacgaaaaaaaaaaagaatctcaatgaggcctcacaattgtatgaaaatgtagttttttttaaaaaaaatcaaacgcagaagccccgtttctttctttttaagcactccatattaatatccagagtgacaaaaaagggaaatgcgacggaacaactcactccagcctgctctgagactcagacacgctttctattccataaagaaaaacctttcacgaggattgcaaaaaaatgcacggcgccagcagcagctactagataggtggccaactgcttgcgttcgactagcgcgcacttgctacttttaacgctgccgaaacgggccaggcacacgaaatccccgtaaaacgaaaagcctggtgctggcacaagcaaagaatttcccttttcattcccgaggcggcgatggagcttcgtgccgtcgagcacgcagtcgccatctccggcttgctcgctcgatcgcctcctgcgttgcgctgcgcagccttcccgaccccggccagcccattgttttcagtgcgcgcgtcgagccagtacgtgaagtcttcacacaggtggtttagtacgtgccaacgatcggaatgcgggagttcggaaccgatcgatcaacacggcccggccggggggccacgctagcttcgtgaccgttacatcctctactgctggcagagggttgtttttttttttttgtatcacagtcagaattaaatccacgagacgtatacgctcgcctggctcttggccggacgcggcggcgtgcacgttcgatccatgcactcacacgccggccgagtccgccggacgtcccggtgcttatcgcgacgacgacatggctgcacggcgcgcgtgcgggggaacacgagagggctccagcctccaggcctttgactacaaggcgacagcccagcccacaccgacgaaatgcggctgccgttacagcgcacgagcacgcgccccgccatcacactctcatgccatgccatgcacctcctctttaaaaccccgcacgcccccacgccgcgcgcacacacacacatcgcctccctcctcctccccaagagccggcacagaggcaaaggccagccctccagtgacaggcagatcgaggccac

SEQ ID NO: 13946 - DNA, 646 bp, Zea mays
gctgttgggaccatgcttcgtcgccgaaggtcctgcaggaagaaacagcttcggctgaagctgtttgtacgtgatgccgaagggtgccggtcatgaagcttcggaattataaaccgacttaaagatagaatgaccttttagtccataagagtttgagttgttgttgtaaacttttatgaggggtatgattgtaattgctcacaggctgtgtcctgtgcctataaatagtgaacagtattcctttactgttcacgcattcttgtaattgcaatcacatcactcggaaattattccttactaaggcagaggtataaatgtacctaaacattatatttgaatatcttaagtttatataatatgtaaatgatgttgtttacttctaatttacttgtctttaatgctttatgactcgtgttattttacattatctttgagaattcaattacgaagatataaccttcgtaattgtgtcattataaccttcgtctgaagttcattaaatccttagggaaataatgtttcagcggacgaaggacattaatatttaacattttatgttgccttgtttttaattcatagcatttgagaacaagttcccaacattggcgcccacctccggtgaactcacttccacttttttgagcgg

SEQ ID NO: 13947 - DNA, 1500 bp, Zea mays
ttgtcctcttcttggtcagtacattagaactggttaccatacatcattttgccctgctcacaatgccctagggtccatgcccgccacccacccccttgtgatgccctgcgaggtttgctatgaagacatgtctgtgccgcgcggcggaggtggagatgcacaagagcaagggaaatctctctggcatcctgcataagggtttcaagcctgacaagtggtaagtggagatcgatttttgttgctcccgggtggcagaggatgggcaacctaacgtctgctttgtttatttattttttcctacaatgatgttgatgtcctagcaagacgccgttgtggatggcggtggcctggatcaagctgatgcgaaatcgcaaggaggagaatgggttgcttgacctgcaatgagcattctcttgatctcttcctttttgatgagatataaattcatatgctaccagaacaagaaagatgagagcggttcgtggccaaggctcctaaaaaagaacctgtgtttttgaaggttgactagacaaatggtaggatgacgatggcgaagatgttggatgttagtatttcacttttggttgattatgttttttcttatgcgcctgacaaatctagatatgcaaccagacatgctttattcttgtttctgttttgttttccttatgtattaattccttaacttgtaatgcacatgatgttttccttatgtattaattccttaacttgtaatgcacatgatgttttccttatgtattaatttcttaacttttaaagcacatgatgaaggctggttgtcggttaaattctcttaaagtttggtaagcttacatatttttgctatagattttttgaatcaattacaaggtaattcatttaaaaatcgtagtaacacattgatagttgcaatgtaggagtgaaacaactaaattaaaataacaaaatttatgtatggatatgatcacaaatatattaagaaacattttctyataacagtattatagtactatttgttttcgttgcaacgcacgggcactcacctaattatcataatatgttcattccgtaccaacgcacgagtgttgacctagtaaaaattgacctagtaaaaattgattgcataacgcccacgtcattgcctacgcgccgtgcgcagttgggtgagcacagggcaggaggggcaatcacgtgaattgaaccgtctccttcgccccgtcttccaaatcccaaagcctcgcccccctgccccgcccccaccgtctcgactctcgactcctctttcccctccccgagcgtgcacgtctcgtcatcgccctactcgctcgccccatcccggagtctccccggctcccaaaccctagcgcctcccggacctcgttacgatccgaccgatccaatttcccttttctccacaccattttttgctgggtgattcttatttcggtggtcggtgcggggggcgtcgacgcgtggtgcaggtacgtgagggggtcggcg

SEQ ID NO: 13948 - DNA, 134 bp, Zea mays
tgcagcaggcaggagctgcacacacccatccaattccagctgctgatcttgatcctgcaccccgagccgtacacaagagctagtcggtagaacttgcaggagcggagcagaactaagtgcagagaacaggacat

SEQ ID NO: 13949 - DNA, 981 bp, Zea mays
taggtcagcaagctgcattcctgtatatagctttgttttatgatactgatgtcctgatactgaataatttcttgtgtatttggatgagtaattgaacagtaggaaatggcacaggaatgggacgtacttctgacacaccaacgccacacgttcagtggttaactgacgtagctttatttgcatgtagctggcgcaacaagtttaataacggacccttaattaatgttaacgacgtataataggtgaaagtaaactgatcccaggaatttaataatgtctacagtgttttgttagcctgttggtttggttttaattcgtaccggtttctactgcttctacattgttttatgtctatggattacagatacagcagtttgaacatctgattttaaagtagaagccaatatcactctttaatctgacagtgatagctgcggtagagacggacctacgtgtaatagagtgaggacataagtgtaatggagtgatgacataagtctccactcatttttgtgttgtaagtaatagatactagattttcactattatatcttctgctcagctcaatttatatgccaccgctcttatattttggtggtcttctgctcagctcacttccattttacccttggtccgcccctgagccgcggataccactgctgcctgatgctttgatctcactgatactgtattgctcatgtagcgaattaaatgtccacttgaatggtataataatgtcaaagggaattgccccaggaacaatgcatccatgcgaaccacgtggggagggttctcgatgcaataggtactattggctggcagcaagcacgtccctcaaggtcagatcttgttcagtgcctgcggagtatatgataatatgacaaatctcagcaaacaggaagcatcgctacaatattatatactagatgaggaagcarccagaccacacacacccacacaccccgcttcacgttctcaata

SEQ ID NO: 13950 - DNA, 1407 bp, Zea mays
ttgcactggcagccagcacacacgagaatggcaatgcgagctgctggaacgaaccggccttctgcatgcgccaaacgcacggcctatatatacatatacatgggtgcgtgggagagcggcgacgctgacgttatcagcttatcgatccacggtcactgtgagtttctgtgtgtgtagtcggcactagattaggcagtagtagcatgcacctctagttttcttttgaccggccgttggtggtgtggtgtcatgcaagtaccgagaaaccagcagacgatatatatccatattgcgtcaaaaaaaattacacgatgttaagccttatagacatgccagtttgctttgaactgtatcgggtgtaccaaaaataatatttagtactataaaaatatatttcatggataattatcgattcgtttttacattaatttaattgaacttaaatttgtttgacccacagaggaacgagaattgttgcactatttcctctacggaggtagggatcgagtgcttattagttattactagttcgatcgaccaaagatttaaataaagattagatccctaatatttattattatgtgaaataagcactcctatttgattagagtaaatcacacgcacagcacatttttacaggaaacgcaatagggaatcgtaatcgtctgatactgttttttatgaattattaaaaaatagttttgaagtaacgttaggttatagcagatcaccaattatcttttgttttaacggcagggaaggagcaggcagcgcggttgggacgggggagtctctgctgtacgctgtgcttgtgcacatgccgccccactacgccgccacagtttcgtgtggccttccttccccaacccaggcagccagcccgccccctgctggtgtaggagtagcaaacgtgtacacctctctagctgcccgtcctctcccgccgttgcattgcatcgcatctttcccggaccggacgaccggtgtcacacaaggatggaacgtccggagtccggacgaccggtgtcacacacggatggaccagctggtgggtccaaaagcggctccgctccgttccgtcctccgccggtgggcccgccgccccactcgccgcgccctcccgggctcccgccacgtgccccctctcccccactaaccgtgacgtggacctcaccaccacccgcatggccgcctccatataaaccgcgccccgcctcgccgtccccttcctcctcatcactctgctaataagctgccccggcctcccctcaagttctctctctctatcgcaagcggccaccttgcacccctggccagtcccatccacaccacccaatcctgctgcgttctatataagctgctggagcatcttgtgctttgttcgatactagcggccacgtacgtaca

SEQ ID NO: 13951 - DNA, 360 bp, Zea mays
ccttttagggatgatttggtgattagggatctctaggggatccatgggggaggaatccccttgcaattcaattttgaatagcaagaggatttcttcccctcaggatccccggtcaccaaattagccctcagtgtcaactcctcctctccgccgccaacagctgcggggagctcgccagtcgccacttcgccagaatggttgcccacacggtggcttctcctcgctttgttcctcctaccggcgtggctgctgatctcggccgcttttgtgtaatttgtttggatcccgcagttgcatcagtgccaggcagtgggtcgcgcgctgccagtccccgctgatgagcaccccaagatctaccgc

SEQ ID NO: 13952 - DNA, 1500 bp, Zea mays
gaccgccaagcaatcgtttttgtatagactctaccattttttttgtttctgattgttttcatccccgacccaactcatggtggatacatggatagatagttagcgatggcgggggaggcggtgatattggttgttcgcttcggattaaagccagttgtttggactaatgctactgcaatccatagagacaaaacattgtagaaacggtagaagtcattttggactgaagccaagcgaagagcttgattggctggtggcttgaatagagagagattgaagaggaaatggatgtcgccggtatagagttagaacctccgtactgggtcatatatgacatcaaggtactactatatgctatgttagaaccgtagtagcgtctatgtaacaccttagcacaatgctatatatatcatctacgtcgtatattcgaagattattttagtgtcaaggcaacacgattttttttaagaaataactaagagcaagaaaaaaaaaacacctgtcaccacaacgaaccctcataaatgccaaaagtttgcttttcgggccttggtcacggctcatcctccctctctcatcttctgttcctactggccaccatttgacgctgctgccccgcaagcccgtacgtccccgtccgctggcccgtcgccacgtgccctcctgtccccttattcaccccatccggccggcgcattcccgaaactgcccatcctgattcctgaccttcggcatgagtcaccatgacgcacacaaagtgcaaccgttgtgtttctgctggctgctttaagggcaggctcatgcagatgctgtgattcgcagttaactaactgtaggagtagtttgtagtttagtcttggttattattattattaacctaggcctatcatgggctgcagtccgtgaagaaaggaaaagaataaagaaatagccttcctgaaatactttacctgccactcttccagttccagttcaatggaaaaaaaaaggtgaagacttgtagcagcaacagtccttcaactttccagagtttcgggagcaaattcttattgccaggtatcgttcgttgacagatggacattgacaccggcggtgaaccgagtcaaatttgtatcgctccatcctaatgtaatcaaggaatggtggatggtcatcggctaggcagtgtagacatgctgaggagttgacttgtgccgctgcagcttgcaaagacgaccagctgggtgcgtgtcgcagatgagatgacgaagtctccctgttcacataccaggggtacaatggtaaaagcgcggtgggacgcgtcgcttataaaaggccatctgggccgcgtcccgttgctgggcaggccgtgcagtgcaggacgaaggcccttcccgccacggccgtaagaacctccctcccgctcccgcaataactactacacaactccaactcgcgcccacacggccacaccacaggaccacactacaggccggagcgagctgcccagcccatccatcc

SEQ ID NO: 13953 - DNA, 1082 bp, Zea mays
tacaggggaaaattataccatgagcaataaaaacgcccgacaaaaccgggcctaatagccgtgattagtagtagctgaaagcgtctcgacgagttgtaatgactgatctctgtttctatgtctccgactttcaatctcctctgtttcttgctagtactatctctcttcggcctgcttgtgtgctactgctgcaacacacgcactctactttcctatcagagtaagagatggttgcgtcgcgtgagagctgcaatgcaagcaatctcctgaggctcagatcgcagaagcgtggctgcggtctgcactgcacacgctctgtggagctgaaccctgatttttctctgcaatccccgtgcgcctgcctgttcgttgcgtttggtttctgaaagacgcctggcagcggtggtccatggggagattgattagtggttccatcacgtgcagcgtcttgccgagcatggtacggcagccggtaggcatgtggctggttgaactgggttccccttctgaatcgaacaaaaaagaacacccaaaaatctgtacggtacgaccgtcgttggaatgttcggacaagagcagcaggccagtagcagtggcagtgcactggagcaccaccaccaccacaaaggtaaccctagccgagtcacttctgcagctgatgatggagaacggcagcgccatcagccatcaggtgggtgtcgaggacgcgggtgccgtgcagcgacgcgacgcgagctccaagacgtcgtgcagcgggctcccgcagtcccacgggcgacgtacagtgcaccagccaccacaacacgaggagcgccgattgcaatttgctagtcccgatggtgactgagagtaacatgtttctaacccaattatagctcgtcccgatggttgtccgtcggtggcgtgatgccttttccagcccatgaagcatctactgggcttgaagcctcgtcctgagtcctggctaacttttgcccggcccagctaggtgcatcgccatcccggggataacggtagccacccacccaacccaaactcggtaaaccattcccctccgccccacctcttgtccagtgccccaa

SEQ ID NO: 13954 - DNA, 236 bp, Zea mays
ctcctcccccgtcgccgccggaaatcaggaagcccaagtggtagcgaacacactccgacactcgccacccccctctcgcccccttcgcccgcagctgccgtcgcatgaaattgacgaactctgcttcctcttctcgatctcgcagctctcttgggtgcgctcgtcgccggtggcagtgagccagtgatgcatcttcatctccggcttccttattaggatcagcccgtcgatcgatc

SEQ ID NO: 13955 - DNA, 493 bp, Zea mays
gcacccgtcacgtcctcggtgccatcacgccggacgtactttcttgcgcggggagagcgagcgatccaacgatagccacacaggccggccgttcctcctcccccaaccccgttcgttcgtctgcctctcgatcggacagctcccgaatccactgggagtctgcgaggccctgcagctgcagctgctgcgggcgtcgtcacgcacgcaagcggacaagcatccgcgtgtgcttataagcagaccctcctctcccgtcccccaaaattccattcctccgtttctcctagctatagccactacctctctgctacctcgctgcctccttcgattcgatccagggtgcgagctctggttagtagtctccccgcaggctcgtggcgtagcagcagattcgttgggaggtggattagcagagctagggttttgtagtcacagtacgttcctcctagatcgagctcgcttattattggtatagcgtctgccgtgcggtcca

SEQ ID NO: 13956 - DNA, 190 bp, Zea mays
ttgaagctgaggagtacaacaaagtgaagtggactggctcactgctcatcctgaagcttgggtcaagctctgcgagtactgggcctcagatgagtacaaagtgatttcagatagaaatcgtttgaaccggaagagcaaaccgggcctccatcgatttggagcagatggatttattgggaaatcacaacga

SEQ ID NO: 13957 - DNA, 239 bp, Zea mays
agtgcgcctgctacaaatcaaagctcctgcactgcagcaccatgctctgatccccatttagagctgatcgtcgcgtcgaggtactctactcatgcacccagccactacgtactatttgctcatcaagctaccaaggatttcttggttacgctagctcgccggtttcttggttgttactagcacccggcggcgtctgttcgtccacagctagccaatctctctctccgggggacgagacg

SEQ ID NO: 13958 - DNA, 373 bp, Zea mays
actgcagcaaccaaggtttagttcatttgggagtatgattttataagataaatttggatatttctaatgatgccaatgatgtggccttttcacagtaccttatcatgttgttgtttttttttaattctggtaggtacctggtggttggcatttagatggacaaaaacgctggataggtaacagcacttttgcagatgtcctcatcattttggctaggaatgcagatacaaaccaactaaatgggtaatcatccttttcttcctggccttattatacttcttgtactgtatctattgttcctttatgtctcaatgactcaatacgaaggtatatctatttttgatcaatgcaaggattaccttgattgctgaca

SEQ ID NO: 13959 - DNA, 717 bp, Zea mays
gaatgtcaaacgagtgcgcaaagacgaagtttgaatgatcaagaatgctcaaagtgttcttggtgtcatcctccatgcgcctaggggtcccttttatagcccaaggcagctaggagacgttgagagcattccaggaaggcaattcttgccttctgtcgactggcgcaccggacagtccggtgcaccaccggacactgtccggtgcgaatttctttcctgttctggcgcagccgaccgttgaagatttggagccgttagcgcaccggacactgtccggtgcacaccggacagtccggtgcccttatcagaccgttggcctggccacgcgtcacgcgcggattgcgcggccgaccgttggctcaccggacagtccggtgcaccaccggacagtccggtgaattatagtcgtacgccgccgacgaattcccgagagcagctttttcaccagagccagcctggcgcaccggacactgtcaggtgcaccaccggacagtccggtgcacccagactaagcagagtcttggctgttttagccaagtcattttctttttggcttttctctgattctagcacttagacaaatatgttagtacacaaaaaccaatgtactaagtctagaatcatacctttgtgttgactttgcacttcttccaccatttggcatagtttcacacttaaaccatttgtgttggcacttgatcaccaaaatacttagaa

SEQ ID NO: 13960 - DNA, 91 bp, Zea mays
ctctccccgagtcctctcctctccggggtattgaattcgaaccaaaaaatcaaaacaactcagcgattcgattcgcggcgagtcaagcggg

SEQ ID NO: 13961 - DNA, 365 bp, Zea mays
ccccggtcttctgtgacattccacgtgtcaggcccagggccatgaattctctgcgcagacgagccgcgcccacgactttttgttgttacgtgcccccggtgaaacgtcccacgcacctttcctggtgtgccatgtgtatgtatataatgtgtgtaaaaggtagtatatgcacggcacggacgacaccagcagcagagccccgagcaatcccttctcgcccttttcacttttcagatccagccagccagccagccatcccactccgcaccgcattcctcgcagtggcagagcttgcagcggtggtctcttccccttcctcctgtctcctcctcgctcgatctcctctcccaagcagcgagaagcgg

SEQ ID NO: 13962 - DNA, 561 bp, Zea mays
tgtcgtgtgtttctgtattttgcttgtgccatgagagctagattttgtaaccggaatgtggggaagattaaatgatggaataatcactataatatacattgattgtcaccaatgttacatatccattatacttatacctctatcaatcaaatcattgactgctttattaatgggtcaaaataagtctattcatacaacacggtgtcattgataataacaatgtacgccacgacggtctcaaatggtctgcattttcagtggcatattcaacgtaggagtaggaccctccaaaaccaataaaaaaaagagggaggggggcttgaccgcttgacacacacactttgctgatcgtagcagcattttcagtgacagataggaaattgatccatcagatggtgtttgggatttcatatcacggagacatattatatactcctacaaaacaatgttttctgtctcggcgtcgtggccgtgggaggaggtgggattgggaaactttaaaaccgcaccccggctacataccgggcaacgctcacttgccgcaggccacgcatcttggag

SEQ ID NO: 13963 - DNA, 1042 bp, Zea mays
atgatttatttcctttattcaccttctaaggaactagagactaaaacagtttaatccctattttagtcccaccgtttagtaatttactaactaaatgagactaaaatagagggactaatctttagtccctccaaccaaatggcctaggactcccctacgatcctacaaactaggactcagcccacccacaaaaaaacatctgagatatattatgttaaattctttttaaaaatcaggaaaatcagtgtgtagctacaaaattgacgcttgggaagagcgccatttaaaacagaccaacggattcgttgcatgtaccgccgtaaagctgaccgaaatatgcctggtaatcatcaaagtttaagccaggggaatcgcggcagaatcgaccgtggttacctcagcaggtgttattttactcgctggacacaggggctcgacgaagtggacgatgggaatctccactgccaaaacgacaattgtttttaattaaaatatcttacagaaaaaaaaaaccacggccgggatccacgcgggcccacagcacacacacccatgacaacgaaacggccccaccaggcaggcaccccacagagagaggccagccccgggcggcgccaaaacagctgacggaagggatgacaaaatcccgtccactggacccttcgccctcgcatcccaccgtccactcgtaccgctcccccgctccgatgcgccacacgcatccgctccggcttgggtcttgccgtcttgaggtcaacctgcctgctcacccgcgagtagggcccgggcgccccgcccacaccccgctccccaagttgcacgtgcgtcacatcgaggccgccccgtccatccgtcgacacgtgtcggagcacccttctataagtaaccccgggtacagctgcgcgatgttccattccaaaagctctcgagacttcctcagcaatcaatcagctttccagcgatcggcagctcctcgatcgtttcgaagctccaatccgcccggccgcctccgcctgttgccactagctaggtgatcgatcga

SEQ ID NO: 13964 - DNA, 1500 bp, Zea mays
caatcgctatatagattggcacaaaacgaagagggcctcaacgagaactgacaggggcatccttgtgtctgctatgtactatctggcctggggcatgacaattcatgcgcctgtttgttggtctaaactgcctgaaatatgcagggttagtatctaatcgaggattcgagcaaaacccacattggaattgtgacatctcacagcgctattctgaatgtcttcagataatacagctaaaagttagttgagctcgagctaataccaatgttattaagaggatccaaatagagcttaaggccctatttggtcagttgcgcacattgtctcgccgcatgttagtcatgctataccccgtttagatgtagatgttgtagcatagaattaaaaattaaaatcagttttcctaaattctattgtttggttccgcgtggaattgtgatttggaatcagagacccaattctctggaattgtaaaaccctctctcctaatacaaagcctcacccctcagtattgttattgcgtggaattagaacgcctaatttcaaactcaaattcaatgacatccaaacaatagaattggaattacatctcatttcaatactatgactgatttggtattgaaaccaattcaatttcatgtcctccaatatcgacattcgaacgaagcataaatgacattcctacgaatttgtattctcttagacactgtttgggaacaaagtttttgaaatactacagtatactttactcatgacaataccacagtttaaaaataccatagtattctaaaccataccttaaaacaactacaatatttacaatactttaatttttaaaaccgatattttaactagcatgctgtatacagatgctgcagtatttgaaaataatgcagtattctttttcaaatttgtgaaaaaacttcactcccaaattgcgaaatttaacatatccggtaattttaacaagagattacaatttcataagaattagcatttaaaggattataattccataagagtgacatttaagatactacaaattcgtaagaacgacatttaagatattgcaattttggctttggaacaacaaaggcaaagataattttcttattttatccagtccattagagtcaaaataaatgtttaattggctgcagtggtataagagtaagaaattaaatccgagtggcatataagtgattatgatatttatgatgacaaataatgtaacgaataaaatttataggggtatgtaaattgttccccttttcataaacaactagtatagtgtttacttatctttttgccatgtaaactggaaagggatctaggacgtcgtttggtctctctgctgccttcttcctccttcctccacccctgccttgctcaaagtagtcagtcgtcatcgtctcctccgatcgcctccagttcattccagttagcgccgctgatcccctccctaatcaccatccatccatccggtaggattccccagcc

SEQ ID NO: 13965 - DNA, 1500 bp, Zea mays
acatgaattttgctcgagcttcaccctttgccggcgaccaccatggcacatttattacatgcacttcacatggcaaggaacacaacacaaaaagacaaattttcctacacaaacaacacaacatcattagttagcatttagcatagtaaagtatatgctttaagagcataagtagggaagcctcaaattatcttaataataatcatttttagccaaaggtacatcaaccatgacttctcacaatgtatgttgcaaaaacatgtaaaagtaggatacatcagagctctcgaaaaatcaatccaatctttaargatgtgcttggaactgctctaggttccagctctaatgagaagttgtagtttataatataaatttaaatattttaaaaacattttaaatttaaataataaagaaaataggttgttaaaataccttctaaaggtttattaatctaacttcatgatcttctagagcatttaatagcctgctctactaattttttggagctaaagcagttccaaacatcccctaaaccaaataattgatcgactctacatgcaacgagaaagcttgaagacaagacaagaacaaccaaacaagtaaataaaactatttaaaatttactttttacattaaaagtgaaatcttataatgataataaagctacctacctgagctatttgcatggaccaccatgctagttgaatttatttaacaaatctgttgcaaaatttgtttgcatgttaaaaatggtttctttaattacatggtacaaaggagatgttcacattgcacatatgctcttctctacgaacacacatataaataataaactatccctcaaaccctatttctataaggacctttgaaagttattgctagagacgagattgacgttgcatacaccacaaaagccattaaatcgcacggagtataatgtttactgaggcccttgtaaccagggaccgagcaccagttcagaacatttgaaattgagccgttgtacatctctatggccattcgtgctcgtttatatgggccaaaattttagctcatctcgcctcaattaattccgacgggcccaacacgtacccaatcatggaggactcttttctcatccactgctacgatcccacccggccccacaggtcagctagcctaatcaatctcctcgcgaaatccagacacttcttcatcgccgcaggcaaacactcagatccgaactctggcaactgggacccacaggtcagagtcccgataggtgttcggccctgccacgtctccgcgtaacccacatggtccacaaccccccggctgtctctacctccttcctcgctcacctcctcacgacgtgaggaatcgatcaggccaccgccgtacccgtcggagatccgctccgcccgcgcgatttcgatccgaaacacctcgtcggatcttcagggatctgactgaggggcagcgcgccggctgctgacacggcgggcacgcgcgcagccagcc

SEQ ID NO: 13966 - DNA, 527 bp, Zea mays
cgacctataaatcataaacacagatggttccatcagttatagagatggaacgacataataacattaagccaaaactgaccgtgacaaaattacaaatttctcgtcctctgtccccactcctctctcgctcgcattcacactcacgcagcgcgcagcaggccagcagcagcagcgcgctcactgttcttgtgccgaggaattgattgccacgtgccaccacaccgagattcatagtacggcgaaattgattgctcattcccctctgcgtcctccatccaccccctgacccccatgtcgttgaatttcttggaatactttcctccgctcagcgccggggcagcatttgctcgcgattaaccgccccgcttttgccgcttatttcagcttgtccttttcccccagtggggaaggttagcatccagcacaagcaaccgccggttcttgccgcagtttctgcgcgctcgctttttgtccgcaagaccgaggagagcgagagcggagaggttcctgtgtggaattcttcagcg

SEQ ID NO: 13967 - DNA, 1500 bp, Zea mays
  unsure (1)..(1500): unsure at all n locations
agtagtttccgctccaattcggatccaaatctctactctcttggttcgtaggtcgtgaatttgtgtcctgcgctattagtctcctaccgatcccactcatggtttggttaggttcttcgtccccttcagcttgggagattggaattagttgacaccgtaggagtaggagataggacctctcgttctacatattcaaacagtaaaggtgctggcgtagtttgttttgcagaatttttgcgtgttcaattaacttcctctcgctcgacgcaagtccgccccgattctgcccaatttggccgggaatagcttccgaagcgaagtccgccccgattctgcccatcatgtagtgttttactccattgcatcgtagtttatggatttatggactgtgttggggttaatgtatttcgtgtcgatgactcgatgtgctgagtcaccgtgagacttttgtatgttagaggttttactgtttgctcattcgctcaattcaggtgaacataaagctggatccagaccacagaatgcatgatattatgcaccattgcacacgtccccagagagttcagagttcccagtcatagatgccttttactgcgtgtcttgacaaaatgaacagtacccagtgcccttgaaatgtgctaggaatataaaggtgacagtgaaactggacagagttgtagaagatgctatctggtcgcaaatctactattcatgcagcagactttacactggaattttgttgtgagcaaaggaaagaggcccatggaaagtttcatgtggttacatttcaagttggctgcctttttaggatctaattgacatcagtatgcacatcagctgataaagaaaggatgtgatccacctctaatacttgctagctggtcaatgtaaataagcctaagtcagtgataaaaagttcccctctctcctgggattgcttatgtagtcacatgttttcacgcttttcagttacatgttactatcaagctacttgtgggtttttagagaaaaaggtaaaaagtagttgaattatagtatgaagtttgcaagctatacttaacttataacttgcaaacagcctgtaacactgctagcctttgtttttttttgttaataaaataatgccttttgcatcatttgattcgttactggacgaatttataattcaaattatgtcaaacctgaattgcacaattaaaattttctagttntttgtggtggaatttgtcttgaaattgtttgcaatgaaagagaatggaaggtttccatgcaagtgttgttgaaataaaatctttagatttcccccaaaaccgtcttatgagaaagctgtcagagtggcttcttattttctgatattttatatgaacaccctctttctgcacagatatgaactaaatttatcagtggtcctattgaatatggagctactgttatatgtcattgtctcatgcaaatgatggtggctgtaagttgtgattgaggaactccattgtctgagaa

SEQ ID NO: 13968 - DNA, 667 bp, Zea mays
  unsure (1)..(667): unsure at all n locations
tttctcagacaatggagttcctcaatcacaacttacagccaccatcatttgcatgagacaatgacatataacagtagctccatattcaataggaccactgataaatttagttcatatctgtgcagaaagagggtgttcatataaaatatcagaaaataagaagccactctgacagctttctcataagacggttttgggggaaatctaaagattttatttcaacaacacttgcatggaaaccttccattctctttcattgcaaacaatttcaagacaaattccaccacaaanaactagaaaattttaattgtgcaattcaggtttgacataatttgaattataaattcgtccagtaacgaatcaaatgatgcaaaaggcattattttattaacaaaaaaaaacaaaggctagcagtgttacaggctgtttgcaagttataagttaagtatagcttgcaaacttcatactataattcaactactttttacctttttctctaaaaacccacaagtagcttgatagtaacatgtaactgaaaagcgtgaaaacatgtgactacataagcaatcccaggagagaggggaactttttatcactgacttaggcttatttacattgaccagctagcaagtattagaggtggatcacatcctttctttatcagctg

SEQ ID NO: 13969 - DNA, 1500 bp, Zea mays
ctctcatggcaaggctggggagattgtttatctcagttcagttcctgcgtaggatttgtgctacttttactttgctcatagattttttaactccaggttgatgctgaagcatagtgaaatcgggctttgtacgagtggtacaattttttttttggaggggtagtggggccctgaccctgattgcgggctgtaggttgtgcatgtgctggcgctattgcttcatgttgatattatgttggcatgtacctgtcaagttctttgccgaagctttaagctataatcatgatctgatggagtgatggtgtcggtggcgcggtggttgttttatctactgcccgtactggtcgaaatcatttggtaggcacagtttgctcttacgtgggatgcactttgtgacgctgatataactgtcgctatcagtttttttcttgggatagattcctttgactgtggtcatgatcgctatggcgctgtctccacaaattctgcatgttttgaggcgcttgtctgtattctttagctccataggttattttggacagaaatggatcttacttcatcacaatgatgcgcgttactccatattcgttactgaaacctgaaatggtgctgccaaatcatcaggttcacctcagtgagtgtttgccgtgtctacttgtgtctatatttctgtttgggctatattttgtaccatggaattaagtctttgcagttcagatgcgtaaccccaacagttgtggttggctaacacacatgcacacaccacttttcctagtgttaacctagttaaacccaccttgcttagccagacagtatttaggctaaagcatcaaagcttattcaagataatccagcttgtcgtaacccagaggcagctaaatgcagagggatttcagcaagagaatcttcaatttgcctgcacacagatagaagcgctactctgttaatgctaagttttttgctctttgttgtcaacatggtaacaatttagtctacatgctttatatagttcttatttcttaatcagtgggaacatgttttggatgtattcgtgccagccagttttacgttactatgtaaatgctaatgcttacgcccatggctttatgttactatgcaactgctaacatccatctattatttaatttatacttattgaagaatctctattgtgcaatcagctgatttgcaccttgtattgcatggtagaacactattaaaaggttcttcctctcgctttaattctagcaaatctttgtcatggtgatatttttgttctcaacttcttttctgtgctgtttgttttaaaggtgttccatttggatgccatctgctgaatatgttgtgcataccctttcttttcagcatcagtgatatgatcaagtttctcttttttttcatctttcagttgctgatgcaaggctttcaaaagattaacagtctcaattgatgcaaaagcaacacaatcacactaaaggtttggattagacatttcagagc

SEQ ID NO: 13970 - DNA, 87 bp, Zea mays
cccatggatcaatatttccctaccgctgaggctatctaaattacttagtttgctaacaccgcttcagtattcgcagggaaggagaaa

SEQ ID NO: 13971 - DNA, 1042 bp, Zea mays
gtcatacacaaaaaaaacaagaaaaaggtatttcgatgttgcatttaatgtattcaaaatttatttagtccatataatcagcagggaaagtttagtaacctacgactaatgaaactaaacgcggtaacgctcgctgcgcgcgtcagttactacttactagtattaaatgacctgtgctgcatggtctcgctacgcaccaactagtactcagagattcagagctgagcatcgttgtgctagctgacagcgtactgtagtcttcccacccataaacctgagcgtcagaaacggtgctcacaatcacagcgcagggtgggcaccgattcgaacgctttctctcctccgccgctgatcccctctcgatttgttgtgcctccagcccccgattcctactgttgtggtccagtgatccaatcgacgtcgacgactccgcagccaccgctcctctcctctcgtcgcttctgccgtctctcggcgtcgaatctcatccggccagtgaccacactctactggccgcccggaaggagttcttccaggattcgagccgttgctgccgtcacctctgcaggcccagcgtcgagcggagatccaatcggaaattcaactgacttcgtcttttatcctccgattcgaacgctttatactccgccgttgatcccctctcgatttgttgtgcctccagcccccgattcctcctcattcgtcggcgatcgaacgcagccagccagttctcctcgacttcttccagtcccacccaccgaggttcttctctcctccgcccccgacagctgattgccttcttgctggtgactaaaacctactagctgcttgcttcgttcttcctttttatttctgggtgcgggcgacgagttctcagatcttcgggttcgcgtcgcgagtggtacatacattcctataataagcagtcccaaaaactcaaacttctcgatcaggttcctcttcttcttcggcgcgcccgtctcggtggacgccacaggaattggctcctgacttttttcaacgggtggtttcgctgggcccg

SEQ ID NO: 13972 - DNA, 187 bp, Zea mays
ggtcagcgacattgaaaaccctctttctttaaaagggataaaacaatatttgttgttatgggatactttgagaggggttttgctttctcaagatactgataagtatgtatggatgcacacttcttctggcagttctcttcaaaatcttgctataaggcattttcatgggatccatttcctttgagcc

SEQ ID NO: 13973 - DNA, 569 bp, Zea mays
gttagccaaataaaaaatattatacaaatagcggagacaatcaataaaaaatcttaattttttttgttgatagtttacgtgggtattgttgtaaaccgtcgcaacgcacggacaaccgaatagtatatatataaagatagacacgtgacacaattgattggccgaggctacacaattccaaacggcccacggtgccgcgagtcatcgcttccagttcatatctatccgttctctctccataacaaacacccgaaacgccaggttataaggcggggagttaaaaaaccaaagcctattcaaacgaggagcaaaaggctactctcggagccggggttgaaccggagcggcgggcggccggccggcctcgcatcttcgccggaggaaaacaaaattaaaggtacgaacctccctctaactcctcaacatcggatccgaacgcgcgcttgatatgcttctcattctgccattatatttctcttgggtttagggttttgggttctcacgctctcatctctattgggttctcacgctgagatggatctcttaatcagttcctcgcgtaggcacag

SEQ ID NO: 13974 - DNA, 806 bp, Zea mays
ctgcaggtgggcggcggcggcgggtgggcggcggcgggcacgcgcacgcaggcacgtgcgtcggcggcggcgatggtagagagcagcgcgcggcagagaggaaaacgcgaaatgaaacagcgcgtggggcctgcgggcgttaaaaaactttatgtccgacggctaccagctcggccgtcggacataaacttattttcgagggccagcgggaatgccgtcggacataagttttatttccgaaggccagcagagaccgtcggacataagctaatgtccgacggtcttgtaggtagccgttggacataagttggccatcggatgtccattggtttactgtagtgaacgctgtttatagagtggagtgctggagttagccggaaagacgaatggttatccatgtctgagctagcttctgttcgtttgcccccactgccgtggtggataggcgaaccatcttctgtttccgtctttgctggcgtacgtggagggaagacgaagcattatatatcgtgcaaatttgtgcgactttttgtttttgttttttgccccgactgacgtggtggaaagacggatcgttatcgagagcagatttctgctccttccgtgccgtggaaaggcgaggcacaccgaccatgccacgtacacgcgctcatctatctatatatctatctatacaagtgcccttgtttggagcatcgcagttcgcacacagcagcagcagcccttctttttggagcagcaccacaggggagatcgatcaatcaatcagcaagcaaagcgcgcacggcacaggtgggtagctagca

SEQ ID NO: 13975 - DNA, 353 bp, Zea mays
tcacttatattttcttaaatgttagtataaaatgcggtacagattcaggattctgataccgaatttagatacttattcatctttttagagagcaaataatatataaaacaatttatttaaaattttatttataataatacgtgtgataatacaagtaaagattaacatcaactttgtcgggataaaatcggatatctacccggcactcccagcccaaatttacgcgttatttctgacagtaggacccgtagcagaagccttcacggtctaggctcgagacgagacggagtgacycactagcagtctcgtacaacgaactatcctgttagccagccctaaacccttctgtcccg

SEQ ID NO: 13976 - DNA, 659 bp, Zea mays
ttgctgggactgttcatccaaatccgagtgttagaagttactgttagtagccatcaaacagccaaataggttgaagacagagtttgggaactcggtttcacacagcgggcaggaaagagagaatgcacctggcgggcgctcttcgccgccggtgagggcctcggcagtcggcacctggcggtagcctatccaaccgcgtcgcagacagagaggtatagagagagggaaagagcgctcgacgacttcgtttcacctacctcacacaagtcctcttggttcacagacggccagagccactaactcagccagcgagctgtagctctcagtctcagcgccggccacacattgagcaagcaacatgagtggagaggagaccagtatcacatcttatccgatccgatctacgtggcagcttccctgctctaacgagacgacgccacgtcagcagcgaagatcctgaacctatccacgagtggccgctgcaggccacaagctgccccggtggctcccatcccacgcctcgccgtgtccaggctttaagccacacgcacttgagctccaccgccactaccaccagtaccacaccactccgcgctagctgaggacggtacagcggcacagaggtgcgacgtacgacgacgacgacgcaggcgccacac

SEQ ID NO: 13977 - DNA, 421 bp, Zea mays
tgtgcgcgtgtatgtatagtgtcttctgcatccattatatatactgtgcagacaggaagaaggaagcagtagtggccggcctctccccactacatgcttcttcgtcgtctcatcctcttcttccaatccagacctccgtccacacccacccatctgctcctcctcctcctccctccctagtacccattttgtctctctcaacagtccctctctctccagtctccacacacccaaccaaccaaaccaaaccaaaccaaaacctttttgctagcttattcacagacagcagcttccaaccaatcaaactcatcgaccgatcgagtgctcgtacaccaatagctcagccagccatcaaatcctagctggaggtgcgtacgtacttggctagaggaggtagacgacgacggcgacgacgaccgac

SEQ ID NO: 13978 - DNA, 644 bp, Zea mays
aaaataagcaagattacacagatatttmtggacattgataatgagagctttgctctaagaataacttgagcagtcttcccacctacattwacatacctaggacgggagaactgcctgggccagacagtgatcccaggcgtaggattttgagtgcctgagagagattcaaccaaacaggcccctagtgtaaatgttggtgctaataattacatagctttgcttattctattaacttagtcccttgcaccccctgtaagcaggcgttaggattgtttaaagtatttatttgtatcgctaaaaatagtcttaacagcacagtagcaaaccttattagcattgatgtgtccatgtcatgcatgctaatcttggcacacacattttacatacctagtacgttggtgccaataactaattttctctcctactatgtcttcttatcttatatatcagcattattggatgtacatactatagtagggcctagggcgtatgacacacaagcattcaagcaaagcaacttatacctattacgtggctttgacctagtttaactgcttggcagttggcatgctatattgctgatgaaaccttgtgctgaatctttgtcaggttgcggcagttactggtggggatccactgaaagg

SEQ ID NO: 13979 - DNA, 581 bp, Zea mays
tagggttcacctagagcaagcgctaaagcggtctaactaacctaagcacttcgcaaagcacctacgctaatcaccgagtgattctattaagcacttgggtgtttgagctcttggaaatgtgcactatatgccttggtatgttgcttggactcccacacttgagaatggccggttggggtggtatttatagcctccacacctcaaactagccgttggacagaaagcagcagctttctgtcgtcgggtgcaccggacagtccggtgcaccaccggacatctactgtgcagtgtccggtgcacgccacgtcagccgaccgttggtgcctatagcagtcgaccgttggatccgaccgttgccgtctgtccggtgcacaccggacagtccggtgccgactgtccggtgccccaccggatagaccggtgctacagccagagagcgcctgtctgtggcctctctgcgcagactgtccggtgccacaccggacagtccggtgcgccaccaggcgctggctgacagccctcatcttggattttttcactgatttcttcgggcttcttctgttcttgagtattggactcct

SEQ ID NO: 13980 - DNA, 799 bp, Zea mays
cgggaaggagtactaaactgctgaatatagccactacagcatcctaccacagctgctacgactgtgcattctgccgcttgcagggtcataaagaccaatattgtaccgtgcctcgcagcaacaagatttaactgtaactgcaactagcatgcagatgcaggaaaatcacattggttcgcaatgatacatggaaatcaaagatcacagcttcccataaagaaatggtctatctgcagtagtatttataaatgtttcaaaaaaggcatctttctacaactcttttgagcgttaatctctgaatgttaggggttcactagaaccctcacagttactagatctgttaataaccaaattctgcagtcagctacaatctaattggtactattagattgcatgatgctacacacaaggtatgacaggtaaaatcatattgttcccaaattcaatatatttggtcatctacatcatcacactccattaggggatgtttagatgctgacctctttgagcttttatcggaggaatctctgcccttaccaaacttcttgattgaccttttcagtgacattgtatagctttgcagattttgctgccctctgaagttcttcgatgactgaactacctcatcaaaagccttggacagtgaatctttagcgactgcatagatttcagcagattttgaaccttcttttgcaaattttaccacatgacagaagagatcattgaaccttgcagttgaaggatcatcacggccccccctcagatcaatgtaattatcagaggtgtcaatattttttgc

SEQ ID NO: 13981 - DNA, 1500 bp, Zea mays
tgtcgggtaccataattagggatactcagatcacaatctaaagtgtctagatgcttgagtaagagaatgtcataagcaaatacgcttccaaccttactaaggcgtgtagaacctaactcctgactcgcccgagaccaaccttgcgcgagaaactcattcccgactcgtccgaggctagcctcgggcgaatagcgtatttctgactcgcccgaaggtatctcgggcgcctccccggagcatgcccatctcggccaaccactccgatccagaacgtacgtccgtacgttcacttacctcgttgaaggtgctaaaagtcaacaaaaggcgacgcgaccacggtctaatctacctatgtaccacttatagaccaagcaaatatacatatattagcacaaattattattttaatagtttgtctagtgggtataccctataccgtactaaactatacgacaataatttttacaagctgttatttcaaaataaatttatactagtaatttaaatttttatctctatattcttatacgttgtaaaataataatttgtgctaatatatgtatgtttgytttaaatacgtcaatattattttataaaaatataaaacagtttcacgacatgaagccacatgacgcaaagggagagagattatctggcgatctaacccgttgattttaatgatatatttaagtctgggtgcaatttttttggtggatttagaggggttataagtgtggggtgatttaggtgtgtgagttttgtaaagtttaaactagtgaattatacaatgatgatataaatatagatggataatattagaccttgttcgtttatttctatgtcacatagattggatgagattggagaattttaatagagtttttgactttactatagacttaaactcacctaaacccctacaatcctcatggattgagatgaaaaagaacaaaccctaaggcatcgttcagttattccaattccatatggattgacatgaattaaaatgtattttaacttgttataaatttaaaccgattcaatatcacacaatccacatggatcaatggtgaaacgaacaaggccttagggctttcgtcaatggtgaaacgcttgttcatttatccgtcaatccatgtggattggatgatattgagttggtttaaatttatagtaaattaaaatctattataatctatttcaatatattctaatccatatagaattgaaataatcgaaccagtacttttttgaataatccctcgtcatggttcctcttcccaccgtccgacgcgaccccagtcgtcaggatcatagtagacgcttccgatcagcttccgtggcctgttccatttccagtccagcacagaaggccctgcccgccgcggcgccgcccactcgttaaaccaccaaaaccaaaacacttcgagacatgcagcttccctgagatctatcgtcacgtcgccagatctaaccaagccccaaatctgcgcgccggca

SEQ ID NO: 13982 - DNA, 508 bp, Zea mays
ggtattgagtcaatttaaatccatagaagttgaaattcattgcaatttatttcaatacacttcaatccacatgaaattaaaagaacaaagtctaaggaatagacattacatggaccttctatcacattcacccacgccagcccatacatgtttgcattgctcttcctcggcctattcgaacgacgtggcccatcagcacttgtagacgacggtcttcttgcttccttcaccagatctgccaacagacgcagtcttcttgcttccttcaccagagctgccaaacgtgtatacgtgctcttcttggaaacatttcgcgtgaattcgatacgaaactgttccatcttccatgataattgctttctcaaaagcagagatgaaatgtttctccttgggtaaaaaagaaaagaaatcgacatgaacgtgtgcacttgctgcatttcagaggcatgaatagcattctggttgcaactagcactgccatactagattccaataccacgcactacca

SEQ ID NO: 13983 - DNA, 98 bp, Zea mays
actccatcaagaaaagcagctaggcatgatggtggacaaaggcctgggtagcaactaggacagggttgagtcagtaccacctgtctcacaggcctaga

SEQ ID NO: 13984 - DNA, 583 bp, Zea mays
ggtttgttgttttcaggggccaataatcatggctatttttttcttatgatgcaaaagcagcatgatctaatttctaaataagaatatgaaaaagacaagtattttttggaagcatgttgtaatggcctgtttggtttgaggaatggagtgggccatccatcgtcttctcgctccttcttgtttggtctgtgggatattcactccttgagaccgttgcagaatgtgatctgttagtgttcaagatgccacttgtcgactcttccctctttgctcatctttgaatgaggaaaccagaatatgaaccaagtcaagataattgctctgaagttttatttttaactgtatcaatagtctgaagttgtgtcrttctgttagaccacaccagtttgagctttattgctgccttgctggtgacagatctgaccaaaccaggtgtagatacacggttgcaccccatttgtttctcgtaagactgttacttttacgtccacataaatcaattgacactctagttgaatggtgatcattgcgtgttctgaagctttcttgtactatctgaactctgaattcacgatattgcatg

SEQ ID NO: 13985 - DNA, 98 bp, Zea mays; identical to SEQ ID NO: 13983

SEQ ID NO: 13986 - DNA, 88 bp, Zea mays
ttgaacattgtaaagaaaaaactaataaggaactgtaaaaatggcatgcttactgtaacgaataaggaatacagactgggggtctcca

SEQ ID NO: 13987 - DNA, 468 bp, Zea mays
ttgaacattgtaaagaaaaaactaataaggaactgtaaaaatggcatgcttactgtaacgaataaggaatacagactgggggtctccaatgcttattcagaaacatattccgtcaaatcggttgatcctgtggctgatgggaccaatgaaccgtaatgcctttgccttggttgtactagtagatctgtacacgacctgtgccaaactatgaactgtcatgtcctcctgtgcccatgtgaggacacaaggcaggccgttttcgtgctccagaagctctgctgaaattatggcgtggccctggactgggtgccaaattcccctcgattccatgcggcatccatgaacgccctcacgatgcccctgtctgccttcaaatatatagctcagtcgccgcttggtccggtacggcttcatgtgtgcgtgcgtgattgaagacggaggcccggaggtgcgctgtcggcactggcc

SEQ ID NO: 13988 - DNA, 1500 bp, Zea mays
ggtccggtgtacacacaatgacgatgtctcagtgccaaatgtgaaataagcaatgttgggaaacaaaagtaaaaaatgcaacgttgttagtctcatttttgaaataagctctctctagggcgaatcggtcagggaagcggtaattgggtcagttggcgaaattgtttgggctgaaagcctctagatataaaaaaattaggttacgccctaggtggcccacagcccaaatccgcccgtgccaaaaatggctctcgatcataaccatctatgtatgaacctagtgggttacaccctttaggggttggaataggtgcatagatgattgactcttgtgcaagtgggaaattgttgaatatatacccaagagacaatcatcatacatgagaatggtaatggacgtttagggtaaaagcacattaacaaagttttatatatacaaaggcattttatccatgcatgtgtaaatattgtgggtacactgctaatattgatgtggcgttgatcatcgacgaaccactttatccatgaatggtggcacacgggaacatatggctacttccactacatcgacatggccttactccattgtgttgcgtgtgtaatggtaacgatttatgatccttcggatgataccttggttaaatgtggtagatatgctattacgtaccatacattcgtttgtctactactactacattaggttgcctgctaatattagctatttataatcatgtactcgccgcatattatcttaattgaacgtggtaaatgtgtcgaattgactgttccggagaataactgtttacaactggtgttgttgtgcactagaaaatacatctagaacttatttacagctagctgcaaaatatttctaagatggcaatcaaggcctaagaatttaatgtcctgaatttaattaatgtgatcctcttgaatatccgggtaagtttcaatgggtggagtatataaaaagatatgtattaccttgagccggtaatataatacaaaaaacggttcgggctagatttcatccatctgcatgagtgcttggctttggcatgcaaagcccacaatacgggtatcgtgcgcattgtgaaaaggggtacagccttacaggaactcaagagcgaattaaaatgaagaatcacacagtcaagctaagttcctgctatcaggtccactacatgcatcggccgatggagactagccagtaggagagctggcaaggcaacgcatcccatggtgacaaacctcgttgccgtgtggaatgatcacacgaccagtcagcggccagatggacagatactgatgcatggtagcatcccggcagctgggtgtgtatcaatcaatatatatgtgcacagcccaagcctagccttgggtcagaaacaaatgcgacacagaccacgcgcatagctagctagatccaccgtaccgtcgcataagctaggccaggcctctgatccatcggccgatcaaagataaggagaccagcgaagg

SEQ ID NO: 13989 - DNA, 1098 bp, Zea mays
ggttatcatgtcctaagagacacacatagtggcaaatttaagaagatgaagcaaaatagatattacctgcctttgtcaaatatttatcggtcactcgtttatttttaaactaaaacacgataaaggaaaaataacgaagtgagtaataatttgcaccaataaacaaaattgcttgcacgatgtaattcgcgtaggcaagcatagactataaaatatgagtattaatctagttccatgaaatatggtttaagtaaacacagtgaagctaaaaggtcgtatatgggtttattcatctaaatcataagtttttaaagcatttaacaatattggaagtaataatcatagtcatatcaggatatgtaatatatgaagcagtaagatgaacaatcgtaaaactgtgtttgtttcgcagaaactaaaccccattcaattacagtccaaaccactgccattgtttatttgtctattgtttctctaaccatatccatcatcaaccaaaagcccaaccgcggttgcaacaataaagatgataaaaaaaaactgcctcaacctcaacggctcaccccctagtcgcctcgccccgccccgccccgccccgccccgcccccgcggcccgcgttgttgttcttgtagtacgcggcagcagctttcttttacctattccaaccctctgggctctggcacacagctactccgcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggttcccatgggcgg

SEQ ID NO: 13990 - DNA, 1084 bp, Zea mays
gtagagttctatttggtagagctcttttaatggcccctcaacagcttcttcaaaaaggctaccaaatggtgggctcctctcgtggcttctccataaaaataggaaggagatgtccctaaaaaccgaggaaagcccagagcctaaaaaggaggcttctctgactcgactctctcttgtcactcaccctcccatgaaaataggagtagttgtgttttaactaaatagagtgttctccaagggttactaaaaataaggatcaaactatttttttcagatgagccagaaggaaagccggtgatgcaaaaatcctaccaaaagggagcctcagaagagtcaacccactttataatagtacacatattcaagttttaaaattatatataaccttaaaaatcatctatatattttgagcttttaaagtgggctaacacgaaccctactagatgttagtgtcggcatgacatgattagacactatagtgccgtgtctagacaatagtactaacacatcacgacacatttactaatagtgtctaataacaccattaatgctggacagacaatctatttagccatctatagatgaataaggttaaaaaacactatctatctcctctcgtatctaatatctatccactatttcaactccaacgctacaaacaaaggtatractatcgtacaacaacagttctttagacggccatatcagctggacacagccaccgtactccgagattagcgcccccgtcggccaaacagtaccggactggccgccgttcacagttcacgccccgcgtggtccctatttcccggcgagcactaggctaccgccgccgccgtcaggtgccggtgcccagaccttcgtcgtgcccatttcaccggcgacgagcacccactaggtatgcccgtccctcctctcccctatctgctttgcgaaaccgagcactcaaaacctagcttaagaatcggatctgattcaggagtaattgcaagtatatgcatgtattattatgcctactaaattactaataacttcgatttttccaatagcccctgcccgcaggtgttgggaactggggatagag

SEQ ID NO: 13991 - DNA, 191 bp, Zea mays
ggtttgaggaggctaaaatctctcagtattcaaaattgaatagcgagggattctaaccccctcaaactcctcctttctccttgctctcaaacaatccctgagagtagttagctttcatatgttgggtgctaatctaatattcaactctcgccgttctgactatgtattttccaggtatcgaacacccaaag

SEQ ID NO: 13992 - DNA, 181 bp, Zea mays
tctagagacgaggcgccctattggtggctggacagtggactactggactccacgaccaactcctcccaactcaaacgacacggagggagagctctactcctaataattccacgggccgcttcctcctcctgccggccgctccgtctattggtgacctcgcccatggcgtgtgggtggcttc

SEQ ID NO: 13993 - DNA, 175 bp, Zea mays
atgtctcgatcaaattagtctggaaagtgcaacgtcaggcaggtaagcacagaagaaaaggcaccgtttgtatcatcgcaaagcgaaatgggagttaaaaaattccattcagacagctatgagaatttcatgcagttgcgacctagtgaaatcctagctcgaattttgcatcaga

SEQ ID NO: 13994 - DNA, 330 bp, Zea mays
atcgatgtcgatcgcaacgttaatcatcagagctccaacgcgatgaagcttcagagggagctatcggagttcgaaactgaagctggcaactgacctggtctgaagacgaaagaaaatgatcatactgattgctaacatacgcgaagtgaaggactgaagttgttctaaagatcaaagcttccctgaaaggtggcagatctattctatgatttgagacattttttaaaagattggattaggattgtagtcacttgtttctgttgagtttatattgtaatcagattaactcaagttaatacctccagtggagaattgtagaaaggagtaacc

SEQ ID NO: 13995 - DNA, 540 bp, Zea mays
tgtgtctcctgcccgaggccacccttgggcgagttcatgactcgggtctcctatttggagttggcctcgggcgaggtgggatttggatcccttgccttggtttggtcgggagtgtgttttgcacgtgttcccttcttacttaagcgtctagtggtttttagaggtgtgatctgggtacccataattatggtacccgacagtttttttatcccaaggttaactgactcgtcttatttaaaaaattcataactattacaaagttacagtgatatcatttagcataaaatatatttagatatagctttgatttttttaaaaaaatgaacaacaagcttgatataaaaactatcaaatgaaaaattaggacggagtgagtataatttatcggtgatatgctgtcattgcttagtaatatcatcaaccatgcttgacgctgatgaatcccctaatgatttttatcaaaatcattaagttaaggtagatacacatcttgtcatatgatcaaatggtttcgccaaaaatcaataatcagacaacaaa

SEQ ID NO: 13996 - DNA, 1422 bp, Zea mays
attcttttatgcatagggtagatgtgaaacctgacatatgattagtcagaatatgatatgcatctcagcctggttagtcaataggcaaagttgggtgtactgaggcaacctgtctggcagcttccagttgaagcaagctaatgtgagaacagcttataagcaagtaattgctactgaactgaaatgaacaagtatggttttctgctatgacacaacttgaaaagggtgtgaaaacctctaatgtcatgacattttttatatcgaacataaacttattcctataagattaaaagttgaatacttcagaaaactggtgtacagaagacaccaacttgaggacttcattcaagcttgctgcatgcagccagatgatccaactaggataatggtttgacttgtttaggcaagcatctggttcacaacttaggcatggcccatggcattgtgacaggtggcccttagccttaggtgtgccaactttctaagttacggtgaccttttttcgctgccacaagctagacaaaaaaaagtgtgggaacaccaggttttctaagccgaatgatccaaaaagactgctggattcttcttcgtgcttatttcaatattgaaaattttgcattgtgtattatcaccctgaagatttattcccctttttcattgtcatcagaggtatttcacgaatggacctgtggttttcagggaggaaccaaccgagccctatacctacctgcagctagatcctccgagaagggtggaagtgaatctggagcaaacaggaagtgaaccttgaacgagcatgcctagtttagcatctcgtgcctatttgtcttcacctttcgagcagactttttcctcctagggatcacatcatgtgagcacaaagctgcatatgtttggatgtttatataatctacctaataaaccgtgatccccagagctgcctgtccaggctgccaactccttgaaatttgctgatgctggtgtaagaattgtgcccctttcttctgataaatggtgcacgcccaagtccacatgccgccagacatcagagctagtgcatctgaatggttgtgctcctgttctgaaacagagtgatccatatggtttttgtgtgtttgtccatactttcatatagcatactagtgtagccgtacagtttacaagctgtatataaggccatccatccattctccagttctcttggtgcatctgaactattttgtcttaagaggggcatttggccccttggttgccaaacagtggcagggaaatacacccgagtgaaaaaaaaatctcccagggaattgaagtgtcatttaaaatccccttggtgcattactttcctggcttttttgtccatttgttgccaaactagccctaactgttctttttaccccttcatacagtggtccagcttccact

SEQ ID NO: 13997 - DNA, 145 bp, Zea mays
ggtaccacattattgaccttcaatttatgactaatcaaagaattgatccctatggtagaggatacaagttgcaatgtcaaatgagttttaaattttttcagcactagtaatttactatgttatattttatttcaatgttctgcag

SEQ ID NO: 13998 - DNA, 106 bp, Zea mays
tagcatccatttcttcattgatttatcacccttcattccaagatggtgctgggttcgaaaggtagaacagaagttctcctcagggccacctgactgatgtactccg

SEQ ID NO: 13999 - DNA, 633 bp, Zea mays
tttctggtgagtttgtgcctgacaattcttgtatgtatttgtgcagttggcctgagtttttttttaatgaactgctacctaaatgtctagaccttgttattatactttgcatttttcaaatgtcctatatacatcaactgatcaactcatcaacatatggaaccaccatttgactggtattccttggtgtaatgagcgattgaccatcctgaatactttactagtaagtaatctggcagccttttgatcatattcaaaataaccaccaggagatcaaactttttctctctccttttgacctggcatactttcgtttcatggaacattaatctgatttgcttgatggttatgttatgcatgactcataatatacctagtaaaaaaggggcaatgataatgtctagtagctagcaagttagatagggttgagttatcaacaccacagattattgattttcttcagctcaatatagtgtaaccttctataagctatactccatattctaactgacatttgcaaacaccagtagatagtttttatatggtgtgagctgtgccatcttcttgttcatttgctagttatcttctattttgctcacatttttgctgccctttattttctcccttccttag

SEQ ID NO: 14000 - DNA, 1110 bp, Zea mays
acggcgatttgaagcacgaggacaactgcagtgcgggtggctgacggtagcgggtcacaggtgtggatgaccggcagtgaaatggacttgaggaggtgtacttcaatagaggagcgcccaagcggcgaatcagggctgctgcctttgctgcctgccaccaagagctccagttctgccctccaccttctcgttttccctcctcctctctccttgaagttgcgtgagctccaagcggtcgatttcctgttcaaaagagcacatatgtggtcagtccttcagttttcccttggcatggtcgattcctgcccagttttcttacttgcggtcaattcggtgcatactgattgactcctgtccccatgcagattcatgtctggcgtccgctgcagttctataggcgtcttcctgacgccatttcatgcctaggcaacacctaatcatatagggcggatgccatcccgaggttgtggcgatcctgacgcccagcacctgcatcacgccttgtcgcctaggcgacacatcataaatcatgatctcatgccttcagagtgaattttattgccactgataaggctggaaaatttcatataaaaataaggcctatgcatcattgttatttgatcaattggtttcttggtcgcttaaaacaatgctggtctgctgttcacacttttgcatcacaaggagttatgtgctatgttgtggaaagcgaaagctttaccctcttttttttacatacttgcaggtttctacgagactcgagttgcttactattcatggcggggagcaccagggtacacttttgcatccataccagattattagcctttcagtttgcgctgctgatgcagtaaggataatgaacaagcaaacaacttcaaactttccttgggaaccaattttagtgataaaagagttaagcatgcatatgtagtggctcaaatgattgttgtgtttataggatgttattgcttcgtcggtcagtaaaagaataattccttgtgatattgtgtaagagcaaaggttgattttgcaatttcttggtatttccttgtcaaatataacagaaattagtgccaccagtatgtgtttgtgtgatggtatctgttg

SEQ ID NO: 14001 - DNA, 1500 bp, Zea mays
cttggtttggcatttttaagagaaaccctaggtgacactggggtgtcacacttctatacttgctttggtttgtgttggcatcaatcaccaaaaagggggagattgaaagggaattaggcttacacctattttcttaattgatttttggtggttgaattgcccaacacaaatatttggactaactagtttgctctagtgtacaagttatacaggtgccaaaggttcacacttagccaataaaaagaccaagaaatgggttcaaccaaaaagagcaagggataaccgaaggcagccctagtctggcgcaccggactgtccggtgagccaccagacagtgtccggtgcaccaccggacagtgtccggtgcaccaccggatagtgtccggtgcaccaggggactccaagccaaacttcgcaccttcgggaattttcagagacgctttgctataattcactggacatgtccggtgcacaccggacagtgtccggtgctccagaggagagcgactctgaacttgccagcttcggattcccgctccgctataattcaccggacatgtccggtgcacaccggactgtccggtgagccagcagagcaacgactacttcacgccaacggtcgtctgcaacgcactaaatgcgcgccagcgcgcgcagaggagcagggcacgcgcgggtggcacaccggacaacctacagtgcttgtccggtgcaccaccggacagccaggcgggcccacacgtcagagctctaacggtcggaacccaacggcctggtgacgtggctggcgcaccggacagtgtccggtggcgcaccggactgtccggtgcgccatgccgatagcagcctccaccaaacggctagtttggtggttggggttataaatacccccaaccccccacattcaagacatccaagttttcacacttccaaccactaacaagagctaggcattcaattctagacacactcaagagatcaaatcctctcccaaattccacacaaagctttagtgactagtgagagagatttgttgtgttcttttgagctcttgcgcttggattgcttcttttctttctcaatctttcttgagatcaaactcacttgtaattgaggcaagagacaccaattgtgtggtggtccttgcgggaactttgtgctccaagtgtttgagaagaagaagctcactcggtccgagggaccgtttgagagagggaaagggttgaaagagacccggtctttgtgaccacctcaacggggagtaggtttgcaagaaccgaacctcggtaaaacaaattcgcgtgtcacacctcttatttgcttgcgatttgttttgcaccctctctcatagacttatttatatttctaacgctaacccggcttgtagttgtgattatttttgagaatttcagtttcgccctattcaccccccctccctctaggcgactttcaattggtatcggagcctggtacttcattagagcctaaccgctcgaagtg

SEQ ID NO: 14002 - DNA, 1500 bp, Zea mays
gaaggaaaaaaaaagagagagagattacggccaatcttggctgtctcgtaaagaccggtcccgaattgccacagctcatgtgtttcccatgcaaccagcaaaaccccagaagtcaaactggatctctgaaccagatctttttcacaactggaaacaatctttcaggcataggtttgctacgcgcttttcgtggcgtgttaccctcggtcacctttgtttgctgttgttccaatgcgcagctctgatggtgtctactcagctctggccatgttcaagatttcagactcgataaacaatgatatgaacaagtgggagtttgattggttatattatgtgatcaagtgagactttctgtagacatgccagcgacaggatctccccgacgggaacagaatcggaggatggagatcctgctatccagcagctcggatcgagcgtttgcttgctctacccgatccgatgactgcatataacccaccaactggcatctctcgtagttgtacatgtccctaaggctatccgcaatcgttacccctaaatttttccctctatatcactttttctccctattgttcccccctattttttcatctcccgcagcggtttcctctaaatactccccctataccccactaccactataaaatatcattttctatactaactatcaattttttatctactaacaattattcgtggacccacagcacagtgtttagggtgatgaacagtgacacgctagatctatggggagagaaggggaccgacacgtagagggcgctgtaggggcaccgctgcggccatagggtgcccctacgcaccgcatgtaaggggagtgggatcgctagggtgtaccgctgcgcacagcctgatgcatgcatgcggccggccagaaagaatcgctcgcgacgcgacgcgagtgtggatggaatggacaggcaggcaagcagagcaggatctgcaggggcaagcaaggccctctgtctggtgctcgctattggctccatctccatccactgatcactgctcctgtgcggagatgcgtggcgtggcgtggcgtgtgtgacgaactgacgggaccagctgctgagctatgcacaaggccaaaggctgctgctctggctctgctagcacgagtgtccgagtggagtggaggaccagagtccgggcacccggcttcgtttctttctgctcgcgcgcgagggtctttctcggcttgggagaggcacaggtgaccccacgcctgtagctgagctgagccgacagccgagagagatgatccagacggctctcgtgtctcgtctcgacacagcagcatccacgttgtattcacgcacatgcgcatgttcaccactccctcttccctgccgatctgtacgcgccccccgacgacttgactgcgtgcgtggtggccatctcggtcctcgtcgtcttcttctccactccgcgcactgcaggcaaaccggctcacgcctgtctcggtgcggtggccggctaatc

SEQ ID NO: 14003 - DNA, 757 bp, Zea mays
ggcgcgagaggaggggagtgaaaggagaagccgtgaggagtcaattttttttggctccgtctaatctctataaaaatgactccaacttttcgatgctccttattgrgagctatttcttagaccgtttggaaggactcctacaaaagccrgagccaaagtcagtttagaagccctgccaaatagaccctaaatcgtagggaatgaggctttctgtcaaatagacatatatcactctcttctctcttaagggaaaagaatcgatcttccaagttctagataaaatctctctcctttttttatcagaaaaaacatacccgtaatttataaaaccaacattaaatagagatgagttataaactgtttagtctataactctcagcggaattagaaaacaaagtaatctagatggttataaagcttagttgataagtatttaactatctaagcttgtattttttttcacctttgcattcgtaatccactataaataaagtttttttatattcataaatccaccgtatgtagcatagacaatacatgtatgaatctattataaagccgatggctaaccagtaactaaaattaacgtgcctgtgcactcctcccgctatctttacttatcaatcgtcttgattacatatagcttattcgcctgatcgaactgcctgacgtggtcctcctatgcgtcagtaactaggattaggttgggctcgagagaaggaacgggaagaacgaggccgacgagaactgggaaggc

SEQ ID NO: 14004 - DNA, 53 bp, Zea mays
ggtccggtctctttgtttgcatgcagtgaaacgaacctgcactgcaggtgagg

SEQ ID NO: 14005 - DNA, 1500 bp, Zea mays
atgcatattgtgatagcgatggcttagcgtgttcaactgttcatcgcaagattatgctaattaatcagggttaagttcctaaacccgtatctggtttaggaccgctaatcctggttaacgcgaacggtgtggaggttgttcatgaatacactcaggtggcgcacatgctagtagcgcatgctgctcggatcaattgcacctgcagttaggtctagtcttttcttgctagaattttgtttttcctaccttaaaaaacataagcttttttatagtattttgtttcaaattacataaagctaatgctcatgtacatacatatatacactcacggatgacaatacaagtccatgtatacacacacgtatcctatggaaacctctatggacccaataagaattatcataggcatcttgttgtcgatgatagtgtagtttaatttctttatggagagtaaatcaatgaaaacatgagcacacatgctagcacaaagaccttatattagggtccgtttggttggagagccacgagagcggagcggttccattcaatattttgagcgtggagcggcttcattccagattttgagagccaagtgtaatcattccggattttgaaaagtgaaacagtgagattccgtcgattatttggagtgagctagttccaaatctgatgggaattcttgatttagggggtgtttgagactgctccacttcatgttttactgctctgctccatgatctgattgttaaacggtctcaagtccaacaactctgctcccaaaaaacaaagagttagggtgaactccaccattttagtagagcagcaaaagagatactccataaaacatgtttttaagatgtaaacgtggagtttagggttaactacccaccaatgccactttttatggaaaaaacaatgattcgttttcgtgtctcttctttccttccgtcgcgctatcacacacatcgtcttcttccccgcgaaaccccgttctccactaccggtccatcgttggcgtcttgtcgcttggggccaagggcccatgtcacctagattacatatttatatagttaagtttaaactgtagattacacgtttatatagttgaggttaaaatattaagtgagatatatgaggtgtgataagcctaaacggcccggagggcccggagggggaatctagagcacgccagcgctcatgtcatgcatgtgttgcgtgcggatgccctcccgaactgtcgtctacacaagattttggtactccgatccgctatcatgtctgttggaccgcatgaggcgtggaacggtagctacacctacacgtacacgtcacgagctggcggttgaggctgagctcgacttagtaggcagcgccacgcttgccatactacactagcaaacattaataacgcaagcggcactgttgtcagtgtcagtgcacagtagatatactgctagctagcttacctggcagccagtgcaactgcactgcacgtctcca

SEQ ID NO: 14006 - DNA, 1500 bp, Zea mays
aatacactcaggtggcgcacatgctagtagcgcatgctgctcggatcaattgcacctgcagttaggtctagtcttttcttgctagaattttgtttttcctaccttaaaaaacataagcttttttatagtattttgtttcaaattacataaagctaatgctcatgtacatacatatatacactcacggatgacaatacaagtccatgtatacacacacgtatcctatggaaacctctatggacccaataagaattatcataggcatcttgttgtcgatgatagtgtagtttaatttctttatggagagtaaatcaatgaaaacatgagcacacatgctagcacaaagaccttatattagggtccgtttggttggagagccacgagagcggagcggttccattcaatattttgagcgtggagcggcttcattccagattttgagagccaagtgtaatcattccggattttgaaaagtgaaacagtgagattccgtcgattatttggagtgagctagttccaaatctgatgggaattcttgatttagggggtgtttgagactgctccacttcatgttttactgctctgctccatgatctgattgttaaacggtctcaagtccaacaactctgctcccaaaaaacaaagagttagggtgaactccaccattttagtagagcagcaaaagagatactccataaaacatgtttttaagatgtaaacgtggagtttagggttaactacccaccaatgccactttttatggaaaaaacaatgattcgttttcgtgtctcttctttccttccgtcgcgctatcacacacatcgtcttcttccccgcgaaaccccgttctccactaccggtccatcgttggcgtcttgtcgcttggggccaagggcccatgtcacctagattacatatttatatagttaagtttaaactgtagattacacgtttatatagttgaggttaaaatattaagtgagatatatgaggtgtgataagcctaaacggcccggagggcccggagggggaatctagagcacgccagcgctcatgtcatgcatgtgttgcgtgcggatgccctcccgaactgtcgtctacacaagattttggtactccgatccgctatcatgtctgttggaccgcatgaggcgtggaacggtagctacacctacacgtacacgtcacgagctggcggttgaggctgagctcgacttagtaggcagcgccacgcttgccatactacactagcaaacattaataacgcaagcggcactgttgtcagtgtcagtgcacagtagatatactgctagctagcttacctggcagccagtgcaactgcactgcacgtctccaatgcgctgctattataacgacgcgaacgccgcgcaggccttccgtggtatacagcagcagaagcagcatcacgatcccggcccggcggcgcgtacgtcgacgaggaggaggaggacgtacgtacgcagagcagctgctggcacc

SEQ ID NO: 14007 - DNA, 887 bp, Zea mays
tgggaaccccgcaaaatccggggaacgaacagtgacagacaggtccaagagcaacagaccagcaggccagccgcctcagctcgggcctccactcgatgcctatcaacccaactaccggccggcccggctccatgcacgctgccgacacaactagcggcaatgatccaaaccgatggaggcgcaggagctgcgcaagtacactggccgcgttccaaaccgatggaggcgcaggcaaggcatgcgtgcaaaaaatcgcaggaaacagcgctcgccactggagctgctggtactatgatggccacggtgattgggaaaggtggctgctggcgccaccatggtcagcggtcatgtggaaggcgaggccgctacgtgcccgcctcctcctcacaaagccctaggcccctcacgacctcccttccccccgtgccgtccctctcgctgcccccgccgcccccgcgtcctcctatccacgccaatctctcctccgtcctcatacacatcacaagagcggggcacacgatgcgttgcattgcatggctccgccacacacaccccttgcatgtaccccacccaccacggcggcataagtatctccgccggctacgcgcgatccaggcccggccgcgtgcgtgcgtgcgtgcgacgactgcacccatacacacatatacgcgctctggctggctgcctgcctggcttgcggagctccgtttcggccggccatctctcgctacgctacgagcgcgcgcggcccccgcgcccgtgtcttcccgctgtcgaccgtcgtgttgatcgtacatgcagctgctagtagcgaactatagttgcagaccgcatcagtgcgtgacaagaggatatatattatcagacacgcacgcgatcgcgcggag

SEQ ID NO: 14008 - DNA, 1500 bp, Zea mays
ttcttctgctcttagttagtttcttcttcttgaatttgttattgagggggaaaatgaaaatgcaactaccttgagcatggaggttagagaatctccaacaaatcacaataagcaaaatctataaccttaatttaagaagaagaaaaaaacgaaatcatccaacagatctctattaaagctccatacttttctgcacgtgaaaaatgcttgcttctctgcagaaattttcgccatcactgtttctcccaatccaccctcccgaccactgacagatccatgagaggggctggtgggttccagcccttctacgccggtagcatacaagtaggagagactgagagagtaagggagaggaagaaagaagaaaagaaatactgcttgttgttatcataaatatttttatagattttcatctaaaattagaaattacccttctgcaggggatacatattactttctatgtgtcactacggaatatatgtggtgaacatttttttcctaaaccaatatttatatctctagaaagtttattataagaataaattatatgattcatttaatggtactaattatgtctcctaaatcttaatatttttttaatatctattaaggacaggtacaaccgtacaaccttaaaacggtggttagttgtttcaagtaaaagagacatttaagagtttacatgatacgaatctaagtctttagagaataaatatagttaagagacattatatatagaaagtcgtgtagagacagattcttcgtgatagaccacttaagactggagaaactctatattaaggggtcgtttggtttctagggactaatatttagtcccttcattttattccttttttattgtataaattgctaaatatagaaactaaaataaagttttagtttctatatttggtaattttggaactaaaatggaataaaatctagggactaaacattagtccctaaaaaccaaacaccccttaattagatcaccttcatctcacgaagcagcctgcggcccgctgagcaaatcgaggcagcttccccgcgattagttgccggcgatcgtcatgcattaggggatcatcatggtcgtcgtcatcatctgaccagttagctaaaaagcgttgagcaacaaagccacacagcacctcatccatcggtctccatttttcctacccaccacagctggaaatcctgagcattccatacagtagtcaaattcacatgcatttcctcagttcatccactgaattctgtatctcacctttttaacgctttctgcgctagaaagaaccaagtggacaggcgtcaactccatggccgatcgatgagccaatatataaatcgcttctagcagtgcttcttttctcgcatcgcatccactactggagccaaagccagcttgatcggtgacgatttattagctagccgtcgtctgatagctcaattggttagctgattaacgtggtgcagaagaagaagttgagctagctagcg

SEQ ID NO: 14009 - DNA, 481 bp, Zea mays
attggaacggagatgcagagagtacatgatggtatttttatattttattgatttatcgaatggttggctaatatctgttattaggacaaactatctaccaaatattggttatctattcgagtagtgtctgatatctttactcattcgaattattatctaattttatgtttttacatgtccaaattattatctaattttattttatatttattctgaattttaattatccgtataaatcttgtatgcgaragaattatattaagaaacaatctaaaaaatatcgtgacgagatgaaccggccgacgcctgtaacggccccaagttccaaagtacgaaagccaggagttggcactcggcacagtcgagtcgagtggcggccttcgagatctcatcggtgttcgtctcagcccagaaggggctacggcgcggagtcggcgagttccgagtggaacctgggttcgattcggtgatcggcggcgga

SEQ ID NO: 14010 - DNA, 1500 bp, Zea mays
atgttctaaaggtgaagtattttgcatgaacacgtgacttgacaatatgttgacgtgaatagatactaatattactcaaattttttttacaaagggatgctatttgatggtgttgaagccgctcaaaaattttacatggactatacacatgacattggttttcctattcgtatcaggcgacaaagatttgataacactggagccgttaaatggaagcgattcctgtgcgcaaggaaaggttataagacaacctcaggctggaaccccaacgaacgaatgacaatcaatcatatttttggataaacaattcttttttctgaagcatttcttcacaaggtacatagacgaaaaatctgcattamcatgcatctttacatctcaatgcargtagccttgcattgccttacaactgatgatgcacacagcacacgtaacgtacaccctgcaaaacgaagtaaatgtgctacaaatgtaaactacatactgaaccaagcctccaataagcaaactgaagcaacaaagagcatcaggcggcgagggaaagattcgcggcgaggaggactccggccgagaggagggcttagggggcggagatgactccggccgagaggagggcttaggcggcggggaggagttggggtggcagggaggctttgccggtggggaggagtagggccggccgggaggccttggcggtggccgccgtcggggaggagtgcgtgcagcgatgagggtttagcggtggggaggagtagggaaggacttggcggcgactggttgggaggagtcaggccggcggggaggagtcgcggcatgaaaaaatggcggcaaggggtttctagcaaaatggtgcgatctgggggaggattccacggttggattgtcatccaatgatcctgaacggtcgctttgcatacccgtcatcgcctttaaaaaggcaaggttacatgtgatgtggccactattttaaatgtcaggctaaaggctttagtagctataaaggctatagctggctatagctaatctatttagcgtgtttttgaaaaaaaaaacataacataactttatagatagtttaaatgtttaatatttaaatctaacagttcaaactagtagtttaaatgttcaataataaatcagcatacaagcaaattaaacgttcaacggcatatgtaaaagatatttaaccactatctaacaaacattaagtaaaaaggtcttcctatatttgtttttggctttaatgttttaaaggctcggccagtaaaaaatattacatgtttaacggctaaatcgagttaatgttgtgtatttagcaggctaaataaggttattaacggctaattttaattagcgctaaatagtgcatcttttagctctagacattgtgaaagactgtagccgactaaatagccgctattagccggctatttaaaaccttggctgtaacccgactcgaccttgttgcttcagcttaacgactagcgagcggcagagaag

SEQ ID NO: 14011 - DNA, 739 bp, Zea mays
gggtggttttggatgcttccaaggaaatggactatctgtactctaaataaaggaaatacactactttgtaattttatcgatgagatttaacacttccttacttacattgtcatagtttgtgagttattttcagttctaaagtattattgtgagcaatgttgagtagtagtatctacatttacatgtggacctactgaagttttaaatttactacaaatttttagatgccttgtttggatcatgaacatttcaattgattctggattaattggtgaatggttctctagcgtaacggttaaggcttccgattagcacctttaggttccgggtttgatccccgtcgggggcgaatttcgggcttggttaaaaaaatcccctcgttgtgtcccgcccgctctcgtggatcgatatcctatgcaccaccctctggctgggctgttgtagagtgggcagttgatcggcccgttagtgataaggggccagggttcgggggttttgtcagccggaaccatgtttcggtctcttcttaatataatataatatcgggagggcggtctttccattccggccgagtttttttattctggattaattggtttaggaaggccgattctagaactgtctacttaccatatttactgaaagtttttaggtttagtacgtagtgttttttttttaattcgataaatgctaattttaaattttcattgtaattgggataatatttttgcattggaaa

SEQ ID NO: 14012 - DNA, 554 bp, Zea mays
cacttttccttcatccgcgaggggcacaacggagggctctccatccatcgtccagggggctccatccgcgtcgtagtcgctcgtccaggtcgcaacccctctctggttcgccgccccgaccttgcctcccaccgcacccttgcctcccaccaccatcgccgcctccacggccatcaccattgcctcgtccaccggcgccacggcccgcccttggccgccaccgacacgtacacggcctactttcgtggccgccgtcctctgctgttggcgcacgctgagccggaggtcggatatctgccaagtcgagctggagacagaggtcagcctctgcctacgaatcatcatcatcagccaacaggtgctaatctgcctttttttattcagcaagagtcgacgtcagaatcttaccacggtccatccaaatttacttgcatcatatgattcttagacgaccaaattattgtcattgattggtctgcaaatacatatggactgttagtattttccttccctacttgtttttaatttaggtcattgtgcagtggtaactggta

SEQ ID NO: 14013 - DNA, 896 bp, Zea mays
gtgtctatgaattgtgggtcgatctgtctatgaaatgtaggtctgatggtaatttgtgaacgtgttcagttgtaatggcaaatatcattctcttgctcccagtcttccacccatattatcatctagtattaacaaaggcaaaacatggactcaaaagtttctctgccatatcacgagatttcggcacttatttgaaatcacacctcacaaggctataaaacttttattcaagcacaaaactaacaaacagccagcctacaaatacccaaaagaaaaggttctaaaccccaaggaaaacagaaaggaaagtagagagaatacycttgatgaaagcctaaaatagagataatatcaggaagacgatctcacacttgggcttcctggagttcctcctgggctgcgcggcgccatccccggatccgacggaactcgacacagcggcgtggctatccattccaccagccgccaagaaaccgattcgcctctaacctacctctaacctgccgcccaaacggacctcgccaaatcgccggcggccgggcagcaagaacccaaggaagcacaacgaaaggaccggcgtcgctggctccgctgcctcgcgatttggttggcgggcggaacgaaggcgaggtggggaaagaagtagaagtgtagaacccagaaggagacgggaaaaagctgcgtccttgccggtgtgccccttctgcgaaggtttgtggaargaggggggtggtttgactatagaagaggaggagagagggggaggtgggcgtggtggtggactggtggtggtcgtgctacccgcgttgaggttgagccggcggagatgaccaactgaccaaggcaagggaggaccggaggagtcgaattgtcctgcttttttttttctctcctgt

SEQ ID NO: 14014 - DNA, 1500 bp, Zea mays
tctcctccgccgcatattcatcaaaactgcctgcgttgggttcgttttttcttaaaaaaaacaaagcctgcacgtcaaaagaaaaacagacaaccgtggatcacacggcggacaagactcctgtagtcctgtacatagtactttccaaagtcactccggccccacctccacctccagtaataaaaaaaaactcccagtctctctccgtgccgtccgctgttcggctccggaagtccccatccgctccacctctcctcctccactcccccgccccactgatcgcggcggtgaggtgagatccgatggcgtcccccatttccttccctcttccccctcctggtgttgtgtgcacagtttgatcggtccgtttcgggtttttgttcggtgttcttgattccgtccgtccgtggtttagggttcttggtggccagcgactcgacctgaacgcgtgcggcgccgatcggggtttgggtgtcggaggacgtggtgtgtggattggaggttattatgtaggatctggggcggaggatttcagttcgattatgctgccgttttagtcttctcgacgcatgtgtttgcgatcatgcaaggtcgaatctttcttagctgtagctgtaagaacgggctgtaacaagtatacattgattggttgatccgctgtgaccattccccatggttgtagtgatttgtccataggtcgtgtcagcaaggaccttcaaaaaagcgcttaagaaccagcagcttaccaccacaattacaggcagtgttcttgaaatctgcgtcacaggtgtccccctaattgctgcctgggtggccacctagcttgcctgatctcagccatcgggtgctaaccaccatccaacacccagttgcctacctatcctcttgtgcttgtcacaaaattttccacagggaattgtcatgtttaacaatttaccatttgctcactcttcctattattcactccttacccaaatgatgattgaagtacctatcacctgtaaccttttgttattcagttctgctccttgtgtaaatttcatcctgtacagtctaaatgtaaactataaaagaatagattggtaattcttatttacttatatactacatgtatgttggaaataaatcgggcacagacctgatatgtgtttcactgttttggaaaaataaactgacagcatgctatgccagtaacagataatgttgataatagaaaagaaaaaccttgatgggtgaataattttaaatttataacagaagtcgtgatggacttctgctgaactaacaatatttatactggagaatgaccttgttgcttcaaattatttgattatttgagtgctgaagcactgaatatttgtgctcttttttcacattatgataactgatgttgtacttgtcttatgcaacagaacatgctctttctacagctcgttgaagttttaaattatattggcattcgtgttgtcaagtctgaactaaagcctcagccaaggtggc

SEQ ID NO: 14015 - DNA, 838 bp, Zea mays
atatatatatatatatatatatatatatatgcatattttttttggcttgtgagttaaacaagctagatcaaactcgcaaacaagtcgaatcgagctaattctttggctcgattatttaacacgctgagccaagtagagttggcttgatatacaaccttatagttgtgtctcaactctcaagcaagcagcagcccaaacaactgtttggctggcttttctctagggatgcaggcctttcgagttacctgacattgtgttgctttaacatatgttgcttgctgcctttcaaacatgatgtagcctgcctacgactcatttttcataaaggacaatgcatgcatggtccaaggtgtatgcatcgatgtgacatatgcactactttgtgcaaaacagattatattatattcattcagtgatttcagtctgatagtgctacgtcaccaaaatgtagcccggtgtactgacgtcgggttgggtttaggagaattcaggtatttcgggtgccggaaatgcacacgagtaggttaacagaggcgctcacccgcgcaccgaaagacacgccagattcaccttcttgcattgcatttcttgttccgacgatcctgactgagttccttaaaagttgttgggggtaaataaactagtcgacaggcccacgcttgccttcccaggctgcgttcttctctgcgttcgcctttctttgcacgaagaaaaaaatctgcagctctgtactacggagagagacggcaagcaggcaaagaagggggaggaggattggattggatcggaggagaaccgagcggaagggaagacggcgagtcggcgaccggcgaaggag

SEQ ID NO: 14016 - DNA, 1500 bp, Zea mays
aactaatccatatgtcttttaaagctagttattcttttgatccatggattctaatgtaaacttgtgcaatatgtcatggatttgttccatacctaatgagctatggatagaatccatatcttccatagtttaaaaaattctcaaacctttgggttatattccatgatgggtttaaccgaataaaaaaatttaagtagtcgtggattattttggggcatggattgtggcatggatttaattccaatccatgataatccagagctggattggtgtaaacgaacaaagccttagagatgttgtgctacaccaaacttttataacgaacaaaattcagtagtacttagtagtgatgtgccagcagtagtattcaatatttccagcaaaaatgcagctcacaacgcatctcatgaaaactataaaaaaacacgggctttttttcccaatgtgaacgaaaagagttaaaataaagccgttggacccattgggcttgaataaataggcttaaaagaatagctcaaataagcccagcccaactaaaggcaccttatcctaaaaccaccacatacacgaggcaagcgggaagcgaggtggagaagaggatggcaatggcgccactgaacggttgccccctgccaaccacctcgaccaccggtcctcctcatctcctcccctcctccgcctccatatccgccttcatcgcctccgaccctgccctcacgctcctccacacgcgatgcgtctccatggcacacctgcgccagctccacgcggcgctcgtcaagtccggcctcgccaaggaccccatcgccgccagccgcgccgtcgcattctgcgcgggccccgggcgcgacgtcttatacgcggagcgcctcgtgaggcaccacccgaggcccaactccttcatgtggaacaccgtgatcagggcgctgtccgacggggcccgaccggacgccgccgtggcgctgttcgtcgacatgctcagttctcccacgccgcccgaccggcgctctttcccatctctcctcgcggcgtacgcgcgcctggggcgcgctggcgacggcgaggcgcttcacgggatggcgctgaagctcgggctcgccggggacgcgtacgtacgcaacgccacgatcgccatgtacgcgtcgtgcggccgcgcggacgaggcactggcactgttcgggcagtgcccggagctagacgtggttgcgtgcaacagcgtgatcgtggcgctcgcgagggccgggcgcgtcgacgaggcgcgctcagtgttcgacgccatgccggagcggaccgtcgcgacgtggagcgccatggtgagcgcgtacgcgcgcgccgcgaggtgcagcgaggccctggcgctcttctccgcgatgcaggcggacggcatggagccgaacgccaacgtgctcgtcagcgtgctgggctgctgcgccagcctcggcgcgctggtccagggcgcgtgggtgcacgagtacatagaccgccacggcgtcgccatga

SEQ ID NO: 14017 - DNA, 1437 bp, Zea mays
aattcaaattgtgattcatgttgctgaggtacgtgtacgtctaacttgacgtcaatgtggtcatgctcgtgcacatatgtgtttgatttgtcaccaacatgagcatcttgaagtgtttctagaagatatagttgtagacgtttagtctccattatttaatttttaacctttttaaaatatattcttattcctacacacttaaattcatattcatattgtgactcaagtgttgaggtgcttgatgtgacgtgtaagagacatactctctatttttcctagttaatataaatagagggtttttaaaaaaataaatacgctccaacaacttatttaaatggttatcaaatatagatgtcttatattccaggttttctaactagccaaagatagaaagcacaatgactctttacagtataaacaagatatagaatgcttgttggagattggaaagatataaaaagtggttttatttaaataactctccaaactataatttagagagtgaaatttagaagaagaaaaaaacccttggaggtactctaacctggcgctgtgcacaatgtgtttcgtttgttcccggtacacaactcgttggtgcctaaataaatcgcaacatatcatgcgcaatcgctacattccgtgcaaacatttgttgtggagcgtccatctgtatcgcgtggttgtccgttaacgtgagaaaattttgtaaaaaacgctcgcgggtccatactgttttgcatgtaagtggggttaagtgcaaaacagtataggtcgttgggcgttattttttgcaaaattttctcacgttcacgtacatctacacgatatggatgcacacagcacactccatatagcaaacgttttcatggttacaccgaatgaagcgtgtatgcacacgatttgttgcctaaataaatagccagtgttaaaccgcaagatgtagcagtcaatttcatggttaccgaatttacagacaacaacaattcgaacgtgttttatttatactcgtgaaaggaacggatcggaggcgctagcgctagcgtggccggtttcctcggcgcatgccaacggccaaagcgaagcagccagccacacacaaataccgcatgccgttgccgcaattcatgggcacagcgacctctcgtctcctctccatctagacaccactttcttctctccgcctcaggcggcgcgcgcgcggctagcttcccggcctcccagcaacatcccgccaccacttcctcctcctcctccgctctctccggccgcgcgcgccgacgtttttttttttccaacggaggccgccgcgcgctgcctttagtttcggacccatccatccatacatagccaacatcacctatagcaggcggagggacggaggaccgtccgtctcgttcactccgcgccgcgcgtggcccgatccagcccggccctcgg

SEQ ID NO: 14018 - DNA, 1500 bp, Zea mays
tcgtttataaatgaataatccagacagacggagcaacatcagcatcaaggatcaggatcatccacattcagccccttttctattcccccagagtgtcaggtagtattactgttgccttaatttggcatgttgttatgcggatattgagcctatttgattcagtttttttttaagcttttatgagaatctggctgtgaaaaaaattggatctgaatattatggaaattatgtgtggatgaagataaaatggtcaaatagggtttaaaatgtaccaaagttacagtttcctactatcacaacgactcggtcaattttttgtttactttgattttgaatgattttgactaaaataattttcataaacacaggccgaaaagttgagcgttgtctgcagcagctttagtggctagaagtttttttaaaaaaaaactgaaacaaatagagccattttatattcgtgaaaagtagaactctatctgtgatcggatattcccgtttgtccattttgtagagtccgtatccgcatccccagttgtccagctccagccgtgcggagaacaggaaccagaagtcagaagcgcttccgtgccggttcaagaatarcagcaccgtaccagccagccaacagggtcgcctgcagttgcaagctcggaactctccggagactcgtagcatcacttcacaactggctctatgaaaaggaccagtagcaacaacaacacgcgcgctggtcaatactgacgacgttcgctataaaacggtcgttcgaagatggcggcacgggacctaactgcagcccggccgatgtggcctgctggagcgcgacacctcgcgcgacttgcgtatggctgccgccgggagcaggaagtgccgttgacgcgcggcgcggtcgcggaaacgaggcccggattcgaacccagacgagacgatcggtgcgactcgcgaccgattcgaaccggatccagcacgttggtagaactggcgacccggacgcgaaacggcctcggatgtagacgccgcaaccgccttctgaatcctccggaggaaaatgggcggggccggcagataggaggagtagctcagaacctcagatagctcggggagcgaaagagagagagaccgacgcgcatcctcatcctccccgcctcaaactcgcgtcgcggggacgtgtccgtttcacacgagtattctgcgtagccacgtcgccggtgtgcggtagcggtagcggtagcggtagcagccagggcccagggctgcttctcgccccttccaaaatcccgagcttttccccggtttcgacccttcgttttcctccgcttcctcctctgctccactgcttcaggaataggtgcctcaggaatataggtagacggagaaaaaaaaacacagagagagagagagacggaggggaggcatcgaaattccgaatccccacctcgccgctcccaccaccaccgcggattgcgtcccgttcgattgcgcaggagtttctgttccagg

SEQ ID NO: 14019 - DNA, 547 bp, Zea mays
ctagttcgtggtgcttgctcattggttgcttagcacgattatttgattcgtctgattagatttgtgagctgtaacaatactgtaataacaggcagttctgcacgctattgtacatatgttgcaagtgtccgtacgtagtgtaatgtgtatgtacaggttcggagattgccgggttaggcgtcttccaagctgaatttacgtagtgttgtgcgtaatgcttgtgcaatggcgatgaaagctggtgctcttcagtactctgtgcgagactgacgacaaaccgcgtaccccgaaatcgcaaggcaaccgccgcaccagcgttcagagcccaatgagtctggaagcctgcttggcccaatggtgcgctgtgcaaaagtgcaaaccgaaaccgaagtcagtggcagaaacggcccttatccacacacacaaaaaagtacgcgacacaagccacgctctccgcttgtggctaagctgctgcacgcgcggaacgacaaaaatccagcactagccaaagcacaggcgaagaagcaggcgagaggccaccacaaac

SEQ ID NO: 14020 - DNA, 873 bp, Zea mays
aaaaacataaatattcccagaatgtcaacataatttaattaaaatccaccatgtaatatgtattgtaagtgcattttttgtgtcccttgtagatattactatgcatttctttaaatttaattagaactaaaaaaatcaacttagtacaagatcagaatggtatatatatctccggaatggacgtggaacaaatggcatcggtttcttaaataaatagaacattgtcattagagatggtaacggatcacaatctaaatatttcttcacaataaattacagcatataattaattttagtttaaaaataaatcgtaatagagtctaatactaatccgattcaatcattaaattttataatgtaaaatctagatcctattaccacccctaactgccttcattttattacgatttatttgttcccacaacgaaacacaggaagcgctaaagcacgatccatccatgcatggaaataaatggtactcataaacatgaagcgggatgaaattcacgaatatctcgtgtacaatttatatcgatttttcttcctagtttagttgaaaagatcaagaaggcatcgtgccctcacccacaaaaaaaattgcaacttggccaatttgctgaaatgtagaccccacttaaagtgattagttgaattaattaaagaggatgcacaattaaagtgagcacacaactggcgacatatataaatgccagtacgaagctgcaggacaagttgtggcactttgcatatatataaatgcaagtaccccgatcatcctctcttgagcatccccaaccccaacccgtcgccggaaaattccaccgcacacgagaccagcaggcgaagaaaggcagctaactaggagaagcaaag

SEQ ID NO: 14021 - DNA, 147 bp, Zea mays
agttttcacttcaaagttctggttagatttgagcacttgtttttcatgaaggtcggctcagtaacttgagtattattaatgacaaaagttacaaacatcagatggctaatgctatctgtttcctcttgtaggttcacatgttaatgc

SEQ ID NO: 14022 - DNA, 642 bp, Zea mays
tctcatcttctggtctctgcctcaacaactgttcttcaattactactgcattctaggggaagactcttgcgctctcttaagcttggttcagtacatgactaattgtgcctcagctgtcgccggcattgtgaattttttaatctacaaaaacatggtgytgttgcatcgttccacacccaaccagcatttgcaattttgtattatccaggtcatcataatagtggggataatgaagcacctgaatagctccctgccttctgagatcaacaaggacagcaacccaagcaaaaaaaaaaaaaaagacgaagcaaattttacagcaacgatgcgctgcaattagacaagcttgcacgcttgtctcgcaaccccttccttcaacatcaaaaaaacgacaacttttgtttggttacggtctccctaaatttgtcacgtcatgcatgcatgcatgcgtttccctttcccccacgagactttgtccattcatgcatccacgtggcacatagaccccgcttaatctcctccgacttttcattccctcagatccaagaagcccgtatcggttcctcgtcctatcgttgcattttttttccatctccgccgctctctctctctctcctctcctctcctctcctttgagccacc

SEQ ID NO: 14023 - DNA, 243 bp, Zea mays
gtagctggaatggtcctaaccacacaagccattgttgttgagaagccaaagccgaagcctcaagtggcagagccaccggagggagcccttaccatttaaaacttaacgttattgaggctgctgtccagacggtgcagatcagttgagaggrtagaactttggtttgagaattttggttcagatccactaggagttgtagagtaggattgctattttgcagacgaagagtaattttactatggt

SEQ ID NO: 14024 - DNA, 974 bp, Zea mays
gagtctctttgccgagagtctagctttgccgagagcggcactcggcaaagccttctttgccgagtgcccgacaaaaggcactcgacaaagattacaacactcggcaaagccttggattccggtagtgatagttgacggtataggtcgtcgcgcaactttataatactagtggaggagagaaatttgcgtgctggcatgaagaaaagctgccccccgaagccgaatagggtttagcaatctcgtacactaccaaaaattgctttaaactatgaccatgatacaatgacaccaatctctactcttytaaagcaccagtttcgacgatgcgtatatttatttccctctcctttgcttctcgtttatcagtgggccattaacccacagatggaccgtaagaaactaacctaagcccaacacaatagggtgatggtttgttcctctctcccacttctctcctaccagtggtttgaccattaccccacagatggaccgtgagaaaccacccaagcctaatacgacagaaagccacacacagtgtagagctcccacatagttatcaccacgctcgctaaaggtgaacgagcgaccgggcgagctataaaaaaagcggtcggactcctttttaactcatacttttcttgaccttttggctaagattgagtgtaatatttattcttatcagtttaatatatctattatgtatattatatattcactttgatattaaatttattttttgtggctattttttgtgggaggttccactacactgtcgtgacgagagattgttgtttttgtgtgtgtccacagtccacacagaccgacgatctcttcctgttggcggcctatataaagatggccatggaagaatgccataaggccattaagaattctctcggtctctaccaaaaaaacagcgacctctaacgcttagctagctctttgtgtcagcgcctgagcatcgagctattggc

SEQ ID NO: 14025 - DNA, 216 bp, Zea mays
tttcgggtcgtgccaggtcgacatgttggccatctatagtatcggccacggccagtagcccaaaaccaactatatataatatagcccatcagcggatcagcccattaggtagcagttccgagtcacacactcacacccggcgctgccgctgcaagctaagcaacaaattgatcagtcagtcacaccctgttctactacgacgacgacattggcttc

SEQ ID NO: 14026 - DNA, 1500 bp, Zea mays
atatgcatgctgcagcaaggcaacaaacaagcatgcaatgcaccccacaagaggccaaaggagaaaatgatttactccccagtccccatggcctggcctggacctatagctagctagtaggcagtatagctagctatagcttctcttctctctgtctatggatgacattgacatgcctgcgcatgcatgccccatgagccagccacacacaatgctcctcctcttcctcccactcccactcccagcgggagcaaggcgcaggagcacagcaaatataggcaggggcagggcgcgagcgagctgcccaccgtctcctcgtgctgtggctgtgccccggcggagagacagcgcggtcagaggcggtgcaggcaaaccaacagagagtctcgtgtgtgccccggcgggcccctgctgccgccgccgctagctttttccttgtggcacccctctccctcctctctgctgcctgtctgtctgtctgtctgtctgtctgtctctctctctctctctctctctgcatgcctgtcgatctgccccagctgcctcccgtgtcccgcccgcgcgctcggcggagtgagactgtgagagagaggaggccgcgcagtgccagtgcagtgcaactttttagaaaagctaagggccgcccttcctcacgtttctattcgccttttcgtcgcagccccacccagcaggcgaccagaccaggcctgttatccgtggtgtgtttttattaattttcagcactataataatgcatagtactataacctatctgaagcagcccacacagtccacactccacagtacgctgaagaaatcactgcagctggttgcacgagaggggagaggagaggggcaggcagaggcagaccatgcgtcctgcgctgccgctataattccctgcgcgcggaaactatagcccacatgccctctgactgattccacagccgacaccatcattccgcaggcctgtagtagtagctttcattcctccgtttgtttgtcgtccctgcgtcgtccacccccaggcttttgccgtaccgtctccttccagtcccaacagccatggcttggctgcacactgcattttattttaatttctagagcgctgaaacccatacacactgctgcatgctacgcattcagtatgtactccattgtagtagactagtatatcctcctcttccctctccttggagttggagcactcgctgttggctgttgccctggccggcggttccactccactatttttaaaaaaattgcgggcagagcaggcttgtatcgaatgatgtgggcactcttgccgtttttctttctttatttcttttattcagtactagtactagtgcatgcatgtatgccactcgcgagctatatcaatcatttcggggcctctcagcgcctgagcgagcggggcgtcgtcgtcgcgcgcgcgctgaatctgatgcacgcacatactactacgcaggtgcaggtgcaggtgatcatatgaactcc

SEQ ID NO: 14027 - DNA, 323 bp, Zea mays
tactttgcttccattgactgcgatgcttctgttcagctttctttcgttggagacatgctataagttccaacttttgctcaagccgatgctggaatatcttcctgttaaattccttccttccaaagggggtctgaatatgacatattcctggttctttacagtttgttttatgatatgactaagaaactttacttgttatgctttgaatcgtttcccattgtttatttactctttttgtacctataactctttcatgcaaacatgacaggtgttgtaattttgtcaagccggaagggcagcagtacttgtagagttgttccacc

SEQ ID NO: 14028 - DNA, 1007 bp, Zea mays
tagatacaacagtagatataaatagagacgcctagcacgtaactatggtcatttgagaatcgggtgtggcgcctacgggactgagtccgacgcctggagctccgagcagccaagaacgatgatccaagtagtggagatggaccgtctccgcaacaaaacaaggaattggaagggacgagagacctacaaggagtaatattgtttgcgttgcttactttagtgcggttaatttggtgagatagcagctgtaatgtgtacagttcctcgctcagcgtagttttatgggcacttatatttttcaagtttaattgtaattttcccttcatttagagacagtttaggggcaagagaattggaagggacaagagacctagaatccactttatatttaatattaaatacaaagatattttaactctctcaatcccttctaattttcttgtttccaaactagacctgaacgttgtgactttttcccggtctttcaaaacgattggaaagtttgcccatgttccgctcagaggagttaaaccatgtcagtttagctaaaattaagctttttatatgaatttgcccctatgtttgtgagtataatgtgttattctaaactctgttgaaatcaaatatttggataatattttgaaagaatttttacaacaaaatttgtgaatatcaaaaatccaaccaaattttaacatgttgcgcatacttaagtaccatttgcagaagttggaagggttaggaattaggataaggcgttaccgtacttggattgtcttttaaaattactgaaaaattctttttgaggccaggtctcctttcagcttgtaaactcgaagctggccatctcgggaagcccagcccaccagaagataacaaaaaaaactgccatgacagcccagtccatccaacgcaacgcagctgtggcctgtgtctgtctgcggcgtctgtctgcgccgcgcggcgcctcgccttcctctcccgccgccgtcgtggtcgtggacgcc

SEQ ID NO: 14029 - DNA, 214 bp, Zea mays
agtaagtcactgcagtactattttgcctatgtagaattttgttttgtgacgtattactgtttgtacatcacctgatctaactatcaatcacatacccaatgatgggcagggtgatattggtgacggccaagacattttggtgagggtgcactctgagtgcctcacaggcgacatttttggatccgcaagatgtgattgtggcgaccaacttgcg

SEQ ID NO: 14030 - DNA, 268 bp, Zea mays
agccacttgcaacatagtgatagtgtctcatatttcttcgtggttcacttttgatgtcttgatgtcacaaatgaaggcatagctcatatcttttgattaaaatatttcatcttccacttacgatgagattatgtagatgctctatatatctaggggttaacgtccaatatgtactgaaatatctcactgcttgcctgtagtttgtgttactttaacccgtactgaaatgcccagtgacttgtggagttgtttgcagatcacataaaca

SEQ ID NO: 14031 - DNA, 375 bp, Zea mays
ggtaagccatttcatattctgtgatatggggtgtttggttccaccaaactaaagtttagtccttatcacatcgaatgtttgaatgataattatggatattaaatatagtttaattataagactaattgcatagatgaagactaaaagataagataaatttattaaacctaatcaagcatgtatttaatacttataattgatattcaaatatttgatgtgtcacgaactaaactttagtcagaaaaacttaacactcctatagtattctatattcaattgaatgttgtcttcaccttgttgactctagctgcttggatctattgttaggccctaccgctgtcaccggaagtgtctctggcctcaagcctggcctcc

SEQ ID NO: 14032 - DNA, 1192 bp, Zea mays
ttgcacgggtacaacaaacaaacaacaattccctacatcccacgatgcaagcgcacgtagaagcacacaactaaacttcgaagcacatgcataagcacgccctacacgggtccacctcaagccacatggaacaaaaaaattcgactgatagggaaaagaccgtcacacaatattatattaaaaagaagttcaatcggagtctgaccgataaaggacacgaaagttgtccccttgtgtatcatgagggtccacacgtatatgtcagatttttactcgtgttttgagcccttccagcctctacacgagaatccattcgtcataagtcaatacatcttatrtgcacacaattagcctaaaattcgctcgcactgtgactgaaactcaggacaaaaaatgttacttagaccacctaaccaactcagtcagagatatttcacccaccccgaacaatacccacatctcccaaccctatccagcgtactttggaggggttagctggtccaatggtacccctattacatattctatatggagggagagaagaaactctccaygcatatgggaggtctaaccccattatacattaattacccctatttgcatggcgcctgcaggggtgccacatgcccgcagcgttaccctctgcaggacscctacgcgccggcccccattctatctcttttgatatagcgtgtcactgttcacaccctctagcactgttcattcttgtagcagtgagtgtacaagtaattgttagtagatgaaaaattgataatagatgaaaagtaggtatagtaaataatattttatggttataatggggtataggggaaaatatagagaaaattttacgggggacggaaagtatgaactaaaaaattgatgatgtgacacgaaaagatgatataagacgtaaatttaaatgaaaccactgccgataccctcggtcattctcccgtgctctgtccgaactcagaagagaggcgagacgcaccgtggagcccaagttgtctcgctgccggcgggacccacaattcggcgacaccctcaacgctttccctactctgtccagcagcctgagtgcctgacttaactttgcttaaaccctcttctccctccatctcccgcgccgccgccgcaaaaccctagctccgacgcccctccgccgttgccgcggccgccagaaccagcc

SEQ ID NO: 14033 - DNA, 220 bp, Zea mays
tgcagcacgatccggcccgtgcgcgcaacattgccggaagcggcggggcgggcggcagtggcggtggtcggcttggtcatggcgggctccatacggatcgtgctgtcaatggccctagtatagggtttcccctaaccataaataaaatgacttgtctctatccttgtcattccgattcggaatttagtggcgcttgccgcaccaacttggggagtgatcg

SEQ ID NO: 14034 - DNA, 476 bp, Zea mays
ctgcagctggccattactgcacacactgttacctccggccagcttaaagattcctttgaaccattttttccatatttttttttccagaaactccgagagaggtcatcagctcatcacactaaaccgaccagagaggagggtacgtacaagagcctgccctgctcgaacaagtacaagaaattccgtgctaactgtccggccgagcagctgcctgcaaactctataaaaggcagccacccttgtgctcccaaaccatccatactcactactactactagctactcatcgaccaatctccacgtgcatcgttccacagcttgcagcgcggcttgttgacagttgacacacacacacacagaggagagagagagagagagagagaagtcaattgagagggacgacagagtgagttagcttgcattggacaaagagagccaaaccagaaccaaaagcaagcaaggagacattgttactta

SEQ ID NO: 14035 - DNA, 388 bp, Zea mays
gatcatatcatcttcactcccgatccgtccttttccttagaccgccgcacatggccactctcactgccaagcgacccccgctctgccagcgtctccctccccgtctccaccccccacccccccagaataaaatgccgagcagctcaactcaactgttctgcgcacacagcgttgccaacttgccatacccataccagagtgctcgcaatcacaagagaaaaaaagaaacttataaggagagagaggagcttagcgctgtctctctctcgctcgtgcgtgcgtgcccaattgcaggaaagccacaaagtctcgtgttcctgggggcagggatctcctctcctctcctctggctctttaaccggagaggcgaggagtagtacggagcagc

SEQ ID NO: 14036 - DNA, 1500 bp, Zea mays
ataaagcacgattgcaaacaccaagcgacaagagcgacaaataacacatggatcactctctctctctcaagtcactaaacactaatgatcacttgtcttaattatggaacttggagagattggaagctttgattgtgtcttggaatggattgctagctcttgtattgaatgtgaaagggaattaggcttacacatatttcctaattgattttggtggttgaattgcccaacacaaataattggactaactagtttgctctagtctattagttctataggtgccaaaggttcacacttagccaataaaaagaccaagaattgggttcaacaaagagagcaagggataactgaaggcagccctggtctggcacaccggactgtccggtgtgccaccggacagtgtccggtgcaccaccggactccaagccaaacttcgcaccttcgggaattttcagaggcgcttcgctataattcaccggacatgtccggtgcacaccggacagtgtccggtgctccagaggagagcgactctgaactcgccagcttcggattcccgctccgctataattcactggacatgtccggtgcacaccggactgtccggtgagccagcggagcaacgactacttcgcgccaacggtcgactgcaacgcatttaatgcgcacctgcgcgcacagaggagcagagcacgcgcgggtggcacaccggacagtctacaggacttgtccagtgcaccaccggacagccaggagggcccacacgtcagagctccaacggtcagaacccaacggcctggtgacgtggctggcgcaccggactgtccggtgcgccatgcgacagcagcctccaccaaatggctagtttggtggttggggctataaatacccccaactaccccacattcaagtcatccaagttttccaccttccaactacttacaagagctaggcattcaatacaagacacacccaagtgaccaaatcctctcccaattccacaaaagcttaagtgttaagtgagagtgatttgttgtgttcttttgagctcttgcgcttggattgctttcttctttctcattctttcttgagatcaatactcaattgtaaccaaggcaagagacaccaattgtgtggtggtccttgtggggaagttttgttcccggttgatttgagaagagaaagctcactcggtccgaggaaccgtttgagagagggaaggggttgaaaaattcccggcctttgtggcctcctcaacggggagtaggtttgtgagaaccgaacctcggtaaaacaaaatctgtgtgtcacctctttattcgcttgcgatttgttttggaccctctctcgcggactcgattacatttctaacgctaacccggcttgtaattgtgattatttttgagaatttcagttttgccctattcacccccccccccctctaggcgactttcaattggtatcaaagcccggtgcttcattagagcctaaccgctcgaagtg

SEQ ID NO: 14037 - DNA, 583 bp, Zea mays
ttttcagacatcccattcaatacaagagctagtgcaatcaatacaagacacaattcaaaagaatcaaagcttctccaagtcctaaattcactccaaacttctagtgactagagagagagagtttttgctcgtgttctttgagctcttgttcttggatcgctttcttcttcctcattcttgttcttcaagcaacttgtaatcaaagcaagagacaccaattgtgtggtggtccttgtggggttaagtgacccgtttgattaaggagaaagctcactcggtctaagtgatcgtttgagagagggaaagggttgaaagagacccggtctttgtgaccacctcaacggggagtaggttctcaaggaccgaacctcggtaaaacaaatcaccgtgtcattcgcttcatttgcctttgatttgtttttctccctctctcacggactcgattttatttctaacgctaaccccgacttgtagtgtgtgcttaagtttataaatttcagattcgccctattcacccccctctaggcgactttcaattagtatcggagcccgatgcttcattagagcctaaccgctcgaagtg

SEQ ID NO: 14038 - DNA, 1028 bp, Zea mays
ttttgctctttacctctattttgtggctttaccctacttttctcgcagagtagggtaactttcagcttcgtgtgagaaaagtgggacaagatcccaaagtttgaaaagaaggtgcaaaattacaattagaaatcaatgtgggggcaagaacaccatagcccctattattctgttaatttatttgagagttgattaaattaacgtttgatatcaaactttacattaagatatttttaaaaatttttttgtttcaacgtacgttagcaacttcttttgcggacgaccgaaagatccaagcatcagtactgaaatgtttaaaaaacaatataaagtttattttgcaaaacagtacagaagacatattacgaaacgatttttctaaatggttttggctcctccaacaaagctgctcgcacgaagaagtgagagtcaaagctgtttttagactaaaatacttataaatttacgctcctttgattactttttgatttttgagaaagaaaaacgggttagaaacgcaaaggcacggcaagaaggaacctctcggcagtgggcactacggtttactgtatcgggagcagtttgctgtgctgacagccgactttcttccacccgctgccagcccgtcccttcaccagcatcccttcctcgccaagaactcgtctcggtctcctctcctgtaccgcaagtccacgcgcttcctcccctctcctctctgcctcttttctccctcctcggtgctcctccaccagaaccctagctgccgtctcccactctcgtcgggcagctctctcagcagcacctgaggccgttgtctctccttgcgcggtctgccccagccctgacccccggagatccggggctgttctcggtaaattaaccttccctggttctccccgactagttcgtctccccaaccccgtccgcctccagttgttgactcctttctgcgttcttgccgtgggtggctaggttctttacgcggaggcggaggttggtttctgatctggggatcggttcgtgcgggg

SEQ ID NO: 14039 - DNA, 1500 bp, Zea mays
cccagcacgggataggcctaaccggaccgactctgccccttaagcccgactcgaaaatattcaccgtgcctgctcgagcccaccaacgcataaatcaagcttaaaattatatcaccataaaaaattgaacatatttataaatcataattgaaggatataactaaataaaataacatatattacaaataatacacatttcacaaataaacgatagacattaaataaaaaatagagctattttgtatgtttgccttgttaaacggggcgagtcctagtccgtttagaaacgattcatgcttgggctagcccggcgggcccaaaactcggaacgagcccgacacgccttccgtgccgggctaggcccgaccccgtatagaaccgaaccgtgtcgggctcggattgggtccaaatagtgggcttcgtgccgggctcgcgggccgtgtgcttatcggccatctatactcttatgccatgtttgtttccctcctaaattatataagttggattatgatagaagggtaggtgagtaaaatatcattttggataacaaataagctgatataagctacccaacactaacttatttcaatttatttatagttccaaagtgatattttatcctcctaccttttcaatataatccaatttatataatttaggagggaaacaaacacactcttagcttgcactttaacgactactacaacgatcctttctattgttgtctttacatgtcgagcgcttgaatatcttttgtgaccaaatgtggttgtcatcttactcaatcctagatgcgaacttaatcaaacgcattcacaatattcaagtacccctctatccttaaacaatattcattttagttcttaatttttatgtttatattcaaatggatgaggatgaatctaaacacacataaaacacatacacgaagaacctattaattaattacaacaaattttaatatgggatggagagaatagacattagtccattagttatctcaagtactaaaaccacacatagttttcagcggccgtctgcgaaccctagacgcatggtgttttcatgagcacgtgtgtagcgtgtactcacggatggtcggatgggagagaaccacgaggaaraaattgtcacatcggtactgcatcaggatcagacaaacatcgccgcagatgactgaggaggcggtgggagaggtttactaacaaggtttggttttagtggatcctgttgggccggatttggccttgtaatctcagttgttagactttgttaatctctggtattaggtcgtaatgtggtcgtgtattcrcaggcgagttggccacgcgtataagaggcaaatgtctgaaatgaaraaggcattgaagaacaaaaaccaaatatccagacctctgtctgcttctctttgcctgtgttcttttcccttcttatctcttctctccggtgattgctggtgataatccaccagatatcacagaaaaccagtgcccaacaaaa

SEQ ID NO: 14040 - DNA, 333 bp, Zea mays
cattccttccaccgctcacctcttctcctccccagtccccactcatcaaactccgcccccatgaatatgatcgggagaagctgctagcatcatctctcgcctccacttcgtcacctcctcgccattctattctatccttcccgccagctgcatatatccccgcgcccaattcggtccccggtgtgtgaggccagctgttttagctcagcgcgcggcgtggcagcaaaaaaaaaaaaggagagcaaggagagcgccggcgccggcgaagcatgcggcggtgagagagagagagaggaggaggaagggaacggagagaacgagagccggaggacg

SEQ ID NO: 14041 - DNA, 158 bp, Zea mays
agtaagttccaccaacaagcctaacaagttcctcaccgccttctgatttcgctgtccgtctcctgtttctcatacgtttgttgggctcggtgacgtgcagggaattcgtgaacagtgtgtcctgtataaagatactttcaccggaggaggtccagcgg

SEQ ID NO: 14042 - DNA, 248 bp, Zea mays
aaatttgtttaaatttgagattaatttgacttttaaaattagaatgatttgtaagttaggaggtgggagtagtatataaactgcagctgcagtactgtctcactttctgtctgtaatgtgaaactgtcgtcttctcgcgcggagcgtctagctattgtgccaatcttcaaatacaatcgccacggctcatccatttgccgccacaaatctgataaccaccacgccatcatcgcgctaccagggtcgac

SEQ ID NO: 14043 - DNA, 424 bp, Zea mays
acacaagtgttcgagctgttgtccagagatgcctggaaggtgaagatgaacaagtgttcttttgcacaaaatcaggtttcttatttgggacatattgtgtctgctgctggtgtcgctacagatcctgccaaaatccaagctatagctgcctggccaaaaccagcaaaatgtcaaggaattacggagttttctgggccttgctggatactataggaagttcatccgtcactttgggatcatttgccatcccttgcatgggctgctcaagaagggagttgtatacgtttggacggacgatcattccacagcattccacaccttgaaagcagctctagcatcaactccggtgctggccttgcctgatttttcctctcagttcactattgaaactgacgctagttcttttggaattggtgctgtgctt

SEQ ID NO: 14044 - DNA, 99 bp, Zea mays
gaattttacaggatcacctattcacccccccccctctaggtgctctccatttggtatcaaagtcgttctcttcatctaagagactaatcgcccgaagag

SEQ ID NO: 14045 - DNA, 121 bp, Zea mays
gcagtagcagtagagtcacacgcacgtcaacggagctgacgcaagagcgtacgtgcacttgctgccattgatgtactggaattggtcaaacaattccaagttctaatcggaacgatataaa

SEQ ID NO: 14046 - DNA, 1309 bp, Zea mays
ggtacggctctccaaacctcgcttttcttgcactcttgcccatcgcagaaaactgtgtttgatgtttggtttgggctaatttctagtctctctattttatttcatttagttttagtttccatatttatcaatttaggaaataaaatggtataaaatggaggaactaaaaattaggctttagaaaccatacaccccctatgtattatgtcatacgatgaaactaaaaatattttgtcaaaaaactaacagcaaaacctgagccattttcatttttttctcgtgcatgaagtcacgtgagtaactgtgtggattgtagtctctgtctgcaacacacagtccatcattgcctaccagaaaacaactagtgttttgtgtttagtttagggtttaggggggccgtacccagagcgcggcggcaaggacaaaccaaaactctgctatatacagggaacaatcacagcaatgagggaaataaccgaagtgctttctgttcttatctttctgttgatttttggtttggttgcttgtttttttagttgcaggggcctcctgttgctgttgctgctgcagctgagagtgtagttggtgtggtggtgaggaagggctgtctgaagcgtctgggaggtagtgctagcggtggcacttccggggcttccaagaaggtgagttttgcattggatgaaacgccagaggtgaagggacgaagacgaaggtcccaggtgattttgccactcgttgttgccaagacaagggggaggcgcaagggtaggaaggcacctagttctgcagcagtgagtggaagcggtcggcggcggaaacacgatggtggtggtggttctgctcgtggaagcgttaccagagaggttggtgcagatgccccagtgacacggtctaggatgaaagtggcgtctttacattctcacagtggggttgaaagtcagaataaccctgctaaggctgaggaaagagggaaggtggtaggaacagctactaggaggaagcagaagcgcaaggcccatgagaatgctggggatattgctaattcatgggcaggaatttctcgtaggatcacaaggagtttaagctcgtcggctgcagcagtctcattgccatgtgatgctgaggaagagagaggggctagaaaggtagaaagctcagtagcagctgatgtgatattggccaccctcgttggaaaaaagaggaggaagacatggtgcaggcctaaggccagggaggaacttcctgccgcagctctaggcgaaaggggtagctcgcagaagagtgatgttggtggcggttctgttgatcc

SEQ ID NO: 14047 - DNA, 253 bp, Zea mays
cctttcgtttctggaatggaagcaatacccgaagctgcgggagccgggaagacgacaagaacagcgggcgagaaatcggaaccaaagacttcttttgaagtccatttgctgcgaaatcaattagaattctgttacagaggtgaatacaatcagtgggggggctttggggtggttgtcaggcttattattgttaactttgctagtagtagctccagagcgcgacgtcagcggctccggagtcacagcagtcttc

SEQ ID NO: 14048 - DNA, 1433 bp, Zea mays
gacaatccagaaacacttgttcgatctcatagtgactgatgaacagccagtgatccaacctataagatggttttaaaaatcaagataagcaagatcctctcgctcctagaatccctgtatggctgtctcagaaaaagaaaagaaagggagaggacaaacaatagtgttggcgttgatttgagcgtacaacatcggtatatgaattgtcaggcggtgctctttgtataggcatggatagtctatgacactgagctggacggtctacaatggcgtagaggatcgtcttgttcgcatcagatctagatctcgcctcccaggggactctatagggggagagaacctagagtgtgtcacagggtcggcaggctacataagacgcctctactcataatgcatacggtaaaatgataactaaaattgattggatcgatcgtggggtttaattatccgtaactcttcgtctatataaagggaagatctaaactcgttacaagtcagttctctaacaattctcgtaataaatttagaaccctatttgatcatgcgcggacggatcgtggcgctaaggaaacagtgcggaccgcttttagtgctcaacaaaaattacaaaaccatcacttacttacttcccagctgcctgggagcaggtgacagcacttcctgtcttcctccacttcactgcagctgcagtgcacaccactctgtctatttgtgaagcagcgagctgcacctgaacagcatagggcctgattggttgcccgcatataggccaaccaggctcacggtatgcggccgtagtgtgtttggttgtaggttgcatccacgtaaccaggcgcgtgctactttgccgcttgtttggtttgccgcatatgcatcagcgcctgtgtctcgcgatgcaaaaaaggagctcgggccaggctctggagatgcgaccaaaatctgcgcatctgtggagccaggctcacgcgatgcacagccaggctgccgcggacctggctcgctcggccatgctgcctagatacggcaaccaatcaggcctataaattctccagccggccagaccccacgcggccccagcatcagataaaaaaagcgtcccagcagctgaaacatattttaagtacccggcctcccaaagaatctactggcaccagctgtttcctttgccgcggccagccgcccaaccgccggcccggcgccttgttccgttgttcgtcaccacggcttctccgcgtgtgaactccaacgtcgcagggcatacctataaatacacctcccacaaaaccacacgctccacacagctaccactcagctcaagctcgatacaagaaaccagaaccagctcactcctcactccacttccactcccaacagcaagctcaagcagtcggtcaccgccggcaggggtcagggtcacagtcacagcagcagcc

SEQ ID NO: 14049 - DNA, 530 bp, Zea mays
ctgacctctctgtgtcgtctcctcgcgagcccgtgaaccctgcttgtggttgtgcacccacaacagcaacaggatgctggatgcgtgcataaagttgcatgcaggccaaaactggctctcttcacaaggcacatccctcttcactctctcctccgtcgtctcgtcactcgtcagtcctcgctctcttcactcgctgaaaggcaggctggtggagtggaagcgcttcactccccttcgtgccagcccaggccatccgcccatcgccttccactggactcatctgcttggcactcctcgcccagtgcttggattcttgcacttggtgcttcccttcgcctacctcacatcaccagcccagatccaatccacacgagatttgcgacgctccggcctcccggcacgaagcctttctagggatcgccacacgccggccggggcgaaaaaagctcttcttggagcccttctgcttggcctctccctctcttctctcccggcgtcattctcgccgctgcttgcgagcaacaccaatt

SEQ ID NO: 14050 - DNA, 813 bp, Zea mays
tttgatgatagatgttttctttcaagtttaagatgactcaattccccattagacttaggtttgcaatgatattttcccacgttggagtttatttaccaaacccaatattctcccatggacaactatatgttgcttgtcatgagcaactgcaagaaacaatataaagatacttgcggcaggagaaatggttggaagcaaaaaaaatcgagtgtgacatatacaaataatattatgtataaagaagtcctcgcttcttatactttgtttttgtgatattcgcattatagtacaatttgatttgtatcagttcatttttatattgattgttgttaaaaaaattgtgagatattgaggtcgataatatatgtgttgttcgtttttatataactattgtgcactaatattttgttgaataatttgtgtgcggcgatcatacggacattgtattagtatgttcatagatgtcattggatggacataggacgtcgtcatgtagaatcttcctcgaatgcaatgctggatttttcagcggctggatccagacgtgtttatcttcataatctttggatcagactcgacgacagcaacaagaaacctactgagcagacagttaagccagcggccggcccatgcgtgtcgaggtgtcattctcgaacacagagcaaccattctagatctcatcggaatgcgcatataaatagatggcccttrgattgctataggtcgcaatcacacaatcatacgaacatcgttgtagcagtaggcacgaagatggtaagctcacctgattctgtgccggccagatcgaggccg

SEQ ID NO: 14051 - DNA, 1500 bp, Zea mays
agtgaagtgagtcacccgcccctaatgtttgaagtaccgacgagcacatggagacgagagaaacgaggaaatgtccaaggaggagggagaacttcacctgtcctgcttggtatggtatctatcttcaactggctctgtagagtactcaggcaaattgcacggcagagtccacggacgggaccaaacaaccacccgtgatccactgcgtcgccagcgctcagcagcggcacacacacgcgtggataggagtccgctccacccacaggcacacacggggacatgtccgtcacggcggcaaccggagaccagaccacgggccagagcgccggaacagagaagacaagtcgtcaggtcaacatgtccccggccagccagccagccagtcaacacccaacacatgctttaccacgcacacgtttgaccacggactctcggctggccgtctccagtcccccactccgcagctccgttcacacctcgccgcgggaacgggagtcctggtggtgttttttattctgctaagtggcccggcccggtcgtctttgctgcctcttgcgaagcgagtgcgccgtaacttccaagaaccggggggtgcgcggggggccggagcccggaggtagcaagcaacgagaggaaggagacgacgacgcggcctcggctcggaggagacgacggcgaggaagcgtccaggggaccccgtacgaaaggtgagctcttggctgccttctctctctctctctgccttctcaaccgaggttcttctcacggttagcttgattcagtcggtggattgagcttcgacatgggactttccagactgcagtgtctctctgttgtcccccgttttcccgttcttcttaaggcgaacttcagaatttgtcttaaccgaatgtacaagtcggatgatccgggtgctcgtcgtaatgccagctactagctgcctcctccatcgttttttttttgggtggtggggggaagaatcggagatcccgctccgacttctgcagctgctctgtgctacctaccactaccagccaccatggctgttggctgacaagccttagttctagttcttctgtgaaggaggcccctttcgcggccggtatctgtaatatctgtaacagtaccgaaaccgtgacgacgcttctctggaagcgttagtttctggtggattgatttgtgggaggctgtcgaagcggaggatacttggcggcctcttgatttatgcacttgtctttcttggccagcagctgatctcgactgctcggtggatcgtgaacggacatcgaatttttcccatgcttaggtccagtccagactgctagcctgctctgctggcgagatatctgattgttgtttccttgtatgctttcgctttcttgcagacttgcagctgcgggtgtcttctgctatcacgatctgaagtgctgaacttggttggaagatactcttcttaagcctggaactgtcgtttccgatggtctggcactttctttcctg

SEQ ID NO: 14052 - DNA, 177 bp, Zea mays
ataatatatttaaattatataatttaaattataatttagattatataatctataagctgaaatgggcagagaaaacccagccgtacccaccaaactcagacccacacactgaaattcccctaaaatcactacggaccacttcaccggcggctcgccgtactccgccgccgtaaaccg

SEQ ID NO: 14053 - DNA, 920 bp, Zea mays
gttcacaatagtgcaccatgttctgccgcacaatcctgtccctccgctcctcatcgcacggatgcgctcccaccacgccacagccgctctcaatcgcctccccaccgcggcagatccgcaatccgctcctcccccaccgcgctcccaccacaccagagccgctgtcaatcgcctccccactgcggcagatccgcaatccgctcctccaccaccgcgctcctcacccacgccagggacaagactgtctacctccacgcccgcctcaccaactccgcggccaccgccaccgccacgcccctcccccatggtcgtcgagtccgagtggtggaaccagcgacgcatgcgcgtcgagggcgacgtgaaataggtgctccaccgcgggcacaacgggcacagtggaggtggaacgagcaccatcgagttctggttccaccgaatccaccgctcgcacaccggatccatcgctcccacatgcccgcacaccggatccaccgctccctcccccgcgatggcctggttccaccgagacaactgcggggctagggtttggattcgtgggtggagcccaaggctagatccagcagggggagggaggtagaggaggggagggaactgctggtggtcggcagtgggcgaaggcgcgacaatccaggatatggattcctgaggttacttcattcgctttgtgctctcccgcgttcttgattcattcgcttttgtgttctccctaaacctttacgcctgccctgcctggcagcgtcacccacccgcccatccacgtcgcgcggtgtagtcatcccctatccgcagccgcctcgctccctctcccacaacaaatccattctcctcctcccactcgacgaggatcgcgaggatgctggaggacgtcgtcgctgtcacgcttgacgttagggcctccg

SEQ ID NO: 14054 - DNA, 677 bp, Zea mays
tgcaggagataaaccaaagcaatctacacgcaacggaataaagccccgaaaaatttacaaatatgttacttggaactcaccttgaagttgctccaacagcttctcgccctttagagtttgatgaagacttttttgtccaaatcaactacttagcttctccccgtttagtgtttgatatgctgcattaaaatatatggcacgattaaattatgaatatttaagtactctcatggttaagtacacttcgtttttctggatacttcatggacttatgaaactgctcgttgtttacatcatgaatgtttaagctacttttatggtagtgttatgcagcttcgttgttcacatggcgcaagaaggattgggtctcagctaattcgtctcctcgaaaactatagctcaaacaatcaaggcctcactttaacacacagcttccatagttcagctccagccacacatctcaccgcctctccacagtcgccaccgcctcaataatacttcttcctcaagaaaacaatcccgtaatccacactcatcgctaacgactcacacaaatcgaatctggaaattcttcccccaatccgtcccaaactcgcctcctcacggccgccgccgccgccgccgccgccgctgctcggtaatccctcatcctccccacctgtccgctcgtcagcgtc

SEQ ID NO: 14055 - DNA, 1500 bp, Zea mays
tatttattcttttcgcatgatatttctagtttcaatttgcatctcctttttatgtgaacacgtatttatatgtactataaacatgttattctttattttttaaataactaaaatgttttttgaattggcgtctacatgtttctattgtaatcaatttcgcttacacttatttttgaaaaaaaaacactaacggggctcaattaatgatcaacgagtatagcatgacctacaacctgagacactatttcagttttacgaaaaaattgcacctcataattagcatatttgcgtcacaattaaattattttatttgattactctaagaaaaaaactggacgtaaaaattataaaaccttgaaagtgcatgtgggataagcgtcggcgtcgtggcgacgttatagtacatagaagtttgattaaataaacctttggagaatgttggattaagcaggtagacatccaaaaacaggagcggaggaactgacaacccatctactgaacacgcattgccaaattaaaactttcggaacgaaacgagggaaagggcacaacacacatttggcgcgcccctctgcggtgtatcaaaacaaacaaaccgcatcgtcgctttcctcgcctctctttccgttttccttcctcgtcgcggtcgtgggtcacttgccgccgcgccggcaacgtccccttcccatccccagccacgcataaatcaatcgatgcattggtccttggcacgacttgattcctgattccctctgctgttctccacccgctctctctctttcgcgtggcatttcttcctgccagcgacgaattggcgcgcgccgccgccgccgtctgcccaggcccttcgcccacccaccaggtatgcctaccctcctcgtcctttcatgctgcgcggaaccgagcacccacccaaaccctaatgtaaacttgtagtcgtattcgggtgatcggatattcggatctgatttaatttaattgcaaatgcatgttaactgaatttccccactaacttcgattcctctgcaaaactcaccgcgtgttttatattgggtccgtcccctgctttgtacataaccttagcttgttactgctattttgatcaaccaaactgttatactattgcagacagacgtgtataagcgagaggaaattatctgccggccattttcactgacagctggtggagtccgagagtaatgagagctgtgaagtttaatggcatgtttggaagcaccagtttttaagaaactggtttatgaaaattgatgtggtttcaaacataccggtttatgtctcagtttataggaattatattttcagatttttaagaaaccggtttatgaaaattgatgtggttctaaatataccggtctatgtctacgtttatagaaattaaattttcagtttattaaaaaccaagaagctagtctcatttagctaaaaaataaaaactggtttcttaaaaaacaatgttgctttcaaacaggacctaaatag

SEQ ID NO: 14056 - DNA, 1500 bp, Zea mays
aagagaggctgcagcgcgcgcggtggatttgagggccttcgccttccggctgccggctgctcagattaattataagccgtgtggcgcgtgcgtagggaatagtagcagtagaagcaagtacactataatgtttagtcgtgtcatatcggtactatacgacactaatatctaatagtgcttgtatcaatctaaaaattattttacattgagagcttaaaaaacatagaagatttttgagaatatatatacaattttagaacttaaatatgtaaaccattataaattgaatttattatgcttaaaactataataaattataattcacaattacaagtacatatcacaatcacatctacatactatcagttggtctaagttatgtttaatcgtgtcgtgtttgtgctcgctcatcgtgccgggtggacccaagcacggtactagacccgtatcataccggcactgacactataaaaatataaaaattgtgttcgtgccgtatcgaaacattaccaaccttaccattcttagtgccggcctatttaacatggcatacttggccatctataaaattaagtggtccactccgtcatggcgcggcggcatggtatgaacacacaagacaagataacaataaccacgcggaaacgatggatgtcatacctcatacgcatgatatatagccagcacaagacagaaacactcgtatttatttccagcatattttttcttcgttgataattaaccgtaatcagtctatttatttggctttaattcataccggcttctactacttttacagtatttttgtctctaaaattatagctacaggagtccaaaaattggttttaatctaaagcaaacatattatcggtgtttcgaccccgggggtccctggaccgacgagtaaattgtcgctgcgtgtcccagcccagatgggtcggcgcgagacgggacacaaaggggggagaatagtaaggggaacccgcggccttcgtgttatcatgcgcccagggcagatgggtgcgcttgcagtagggggttacaagcgttcgcgtgggagagagagagagagagagagcgagagctttatgcgtcggcccgttctcccgcgcggccaaccttttcgtacgagagccctggaccttccttttataggcgtaaggagagggtccaggtgtacaatggggggtgtagcagtgtgctaacgtgtctagcagagaggagctagagccctaagtacatgccgtcgtggcagtcggagaggttttggcaccctgttcatgtgatgtcgtggccatcggaggagcgcttgggccctgtggaaggacagctgtcggggctgtcggatccttgctgacgtctccttgcttccgtaaggggctgagagccgccgtcgtcatggagcacgcggggcgccatcattacttgtttaccgggacgagccagatgggacgccggtcttgttccccgtagcctgagctagctaggggtagggtaatg

SEQ ID NO: 14057 - DNA, 1437 bp, Zea mays
ccttacggaagcaaggagacgtcagcaaggatccgacagccccgacagctgtccttccacagggcccaagcgctcctccgatggccacgacatcacatgaacagggtgccaaaacctctccgactgccacgacggcatgtacttagggctctagctcctctctgctagacacgttagcacactgctacaccccccattgtacacctggaccctctccttacgcctataaaaggaaggtccagggctctcgtacgaaaaggttggccgcgcgggagaacgggccgacgcataaagctctcgctctctctctctctctctctcccacgcgaacgcttgtaaccccctactgcaagcgcacccatctgccctgggcgcatgataacacgaaggccgcgggttccccttactattctcccccctttgtgtcccgtctcgcgccgacccatctgggctgggacacgcagcgacaatttactcgtcggtccagggacccccggggtcgaaacaccgataatatgtttgctttagattaaaaccaatttttggactcctgtagctataattttagagacaaaaatactgtaaaagtagtagaagccggtatgaattaaagccaaataaatagactgattacggttaattatcaacgaagaaaaaatatgctggaaataaatacgagtgtttctgtcttgtgctggctatatatcatgcgtatgaggtatgacatccatcgtttccgcgtggttattgttatcttgtcttgtgtgttcataccatgccgccgcgccatgacggagtggaccacttaattttatagatggccaagtatgccatgttaaataggccggcactaagaatggtaaggttggtaatgtttcgatacggcacgaacacaatttttatatttttatagtgtcagtgccggtatgatacgggtctagtaccgtgcttgggtccacccggcacgatgagcgagcacaaacacgacacgattaaacataacttagaccaactgatagtatgtagatgtgattgtgatatgtacttgtaattgtgaattataatttattatagttttaagcataataaattcaatttataatggtttacatatttaagttctaaaattgtatatatattctcaaaaatcttctatgttttttaagctctcaatgtaaaataatttttagattgatacaagcactattagatattagtgtcgtatagtaccgatatgacacgactaaacattatagtgtacttgcttctactgctactattccctacgcacgcgccacacggcttataattaatctgagcagccggcagccggaaggcgaaggccctcaaatccaccgcgcgcgctgcagcctctcttgctcgctccttcagctagcacgcaacgcaacctccctcaggtgtcgggtgccggcggcc

SEQ ID NO: 14058 - DNA, 484 bp, Zea mays
gtgactagtgagagagatttggttgtgtgttttcgagctcttgcgcttggattgctctcttccttcttgattctttattgcgatcaaactcacttgtaatcgaggcaagagacaccaatcttgtggtggtccttgtaggaactttgtgttccaagtgattgagaagagaaagctcactcggtccgagggaccgtttgagagagggaaagggttgaaagagacccggtctttgtgaccacctcaacggggagtaggtttgcaagaaccaaacctcggtaaaacaaatccgcgtgtcacacctcttattagcttgcgatttgttttgcaccctctctcgcggactcaattatatttctaacgctaacccggcttgtagttgtgattatttttgagaatttcagttttgccctattcacccccctctaggcgactatcaattggtatcggagcctggtgcttcattagagcctaaccgctcgaagtg

SEQ ID NO: 14059 - DNA, 1500 bp, Zea mays
cagaccgttctcaaagtgttcaagccaaattgacgagtgttcctaggtcacccttggtcggttatgcctcccctgtagctagactaggcagccgtcgccgaccatggccagtacatgccgcgtcggtgatcgacggcgagcgcgccgtggccagggatctatttggagaagaaacaaaggtcaggggacctttgtgtgattgtcagagagagagagagtaaatagtaactagggattcttaatagaaattcaaaacagcaagggcctctgtgcaaattgccagtgtgggcgtgcgcgcgtgggcccgtccctgtttcctgtgcagactgggccgactgggctgaatgaggtccaatactattcactgtttttctttttctttttccgccagagctaaagaaattctagaaaattgtagaaaaatcctaaaaataccaaaccaattttgctgggtttctaatttcctatagtatttaataaaaatagtttcacgatttttagtccaaataaaaaattatagagtatttaaaacaaccaaagaccatgcttatggatttttaaagaataaataataaatccaaaattcactaaacttttagggtaatctctaaataatatttagaagccttaggtagagtttgatataatttggaccatgtttgatgcttagaacctaaaaccctagtccctgccctataaacttcactattgacttcggaaaccctatgttctcggagatccatgaaggaaagttgtactcaagactttacataacaaacttttattatttttgcatcttcatgagcattacatgagcattcattattatatttggctatatctagaaaacgaagaggaagtagaagaagaagcaaggacaccaccaccaccaccaccacctgaggaacatcaggcaagcagctgtttctattttgatatctgcgggaccgagcctgattcaccagtaacactaaatattagtcgatgatggaatgggtcatgtcctaacaaatctccatatcaccgattttattgttcccgaacgaagaaattagccagcacgcatatatattctgcttgttgatcaagtggaaaactggcaatgtcaacaacacgcctttgcaattgaatcgccagctacgattccagcgttcgtgtaccagctaacgacctcccaacagcataattgttgcagctagcgaacatgataaccgatttttttatttttttaaaaaaatactaataaagccatgcgttcatctctataaataccctagctaattaacttggtgtctcgcattgccaccactccaagcatttacgtctctttccccaggctagctagagcgcaactttgcttgtagcttgctagcagctttctaagatcttgggtataagttaataatatacgatcgaggatcaaagagagctagctaggcgagatatataactataagcgcgctgaagaactaagcagcgcatatcatggcgatgctgatg

SEQ ID NO: 14060 - DNA, 1500 bp, Zea mays
attagcaaggttaaatggctaatgaacaaatagtttgcgaacctttaactaataatcagcaaatttattagtcaacatgtttggaggttagttaaggtgctaaaattagcatggatcttaaaaaaaaagttccaaaaaagcatgaccagttgcatatagggagttctgctttccacgttcttcttcagcggacctgctgggaacagtaacagcctaaagcgacgaatgattggcgtgtgaacattacatgtttcgacgactcctggtcctggccgcgttttatcgcatgccgcgagcacacacgtgctccactcgatcgacgggtcgggtctatctttacagtacagaatatgattcctcgccgtcgccggtggtggtctatgcgatcgctccaatatccggcggacagacggacggacggatgccctgcagggttcgtcgtcgacggcgaggacgaccggttggagcgtcgggctcggaccacacgtgtccgcgcagacggtgcgtggcgtgtctcacggtgaaccgggtatgctggccacgacaagacggcgcaagggacaaaattaatgaagttgttggatgacaccatgctgcaggggagggtagatgtagcattcattatctcaaggtgtctggatccagctccagccacccgtatgtcatttttacatgtccattttataataataataaaaagcagtcgatcgtttttattaatcataagaataagggagttactgttcaggcaagctccagcatgatgacccgatcgattgcggagaaggatttgttccgttccgttccagacatttttccaaccaaagtcaaggtggatctctttctttctatatatatagtttatacatacataaaaaaagggtcaatgtgagcgtatctgtttggactggagctgctcttccgatccaagcgtggaagcatcattaccactcgactctatagccactagtcactcagtcaatcatccacctgcgctgccgctggaatttaattaaaaaaaaagagcccgatcgatccagcaaagtgcatcacgccgttcacggcttcaggacatagggagctcccaagttctcctcctcctcctcctccacctcctcctcgtcgtcgtcttctctctcaggtctcagccatcgtatcgtccggacccaccgtatccccagtccgccggcggccgtcgattcattatcccggccgcccgggctgcccgtaagtcaagcggcggcggcggcggcggctaaggtatagccaaggctggagcgaggccggtgcggccgaccatccctgtgtgtgcaccctgcagaaccaacctcacccccgatcaaggtagcaatgactgacggtaacatggttcttttttttttctcatagcagttagtctccattacgatttccccaatctcatagcagttagtctgacttctctatactcttcagcatgaatgatatatactatgcatatctgctctgctaggttcttgg

SEQ ID NO: 14061 - DNA, 588 bp, Zea mays
ttatgttagtactaattaactaactatgaggaatagggtggtgatggaccaattcattccattataaaaatcaaacaaataaaagtgagaagtgagaagatgatggactagcttattactcaaaccaaacacctcataagtttcccccttgattggttttcttttctcgcgaatcttcctccatatctggtattggaaagacataggaaaagtaaattatgttcattccgaaactagattctgtccattgcacgtgtggacaaattttagctttattttttccagagttcttccttacagaggtgttaacgtctcaacagggaagcaggttaggaattacaactgtagtttccacagattcgatacgtcacatgatgcgaagctttgttgaagagaataaaaaccctcttctctcggcatcaacttaccatgcaggtgaatgtcttgatccagtagcagttgctgaagcaaaagttaggaggaaaagcaaaaaaacgctcaggcgtatcaagcaactcaaatattgattatgcgaaaagtggggctcttaccgaaaaagttgatgggaaatcaatcgggaagaagcaa

SEQ ID NO: 14062 - DNA, 368 bp, Zea mays
tcctctagagacgactctgcaggtacgctagcttgctacattccctcctgcgccgccgtcccccgcaacgttctgtgggtggatggggcgctcgtttcttctgggtgacaagccgatgcacgcgcgtatcttgctgcgcgaagggttggggttctggattgattggttagcagtaggctatgtggtgcacatgattgaattattggtggtgtgcctggtgtgtttatgtgcgtttaatgaccatgcctgctttgatatcgtgctgctgggctaacgaggatggagctttggcagctccgtttgttgttcagctggatgacgtggttattgcattgacgtgcaggtaagaaggtaaggaagagggcgaa

SEQ ID NO: 14063 - DNA, 587 bp, Zea mays
ttaagatttcatgcaataaatcctgatttgattattattcaatgttgacatatgttctaaattcctgaaggtcatatgcacttgatcctgagcacaatgaagaacaatcatccatacaagacgtaaaaccagatccagaagaaacagacagcaaggatgtagtcttaccaggagtaaatcttatatttgatggagccgaattacacccctttgatattgctgcatgccttcaagcacgtcagcctctgtggcttatatctgaggcatcaactgcttcatcaacattactatgaggggttaattatgctccaatttctacaagttggccgatgaaatttcattagttggggttattcaaaagtattgtctgattcttagaagaacacaatagcgggctgatgctttgttcactataactgagttctttcacaggaattaatcagatgctcctggttaactgggatgcgcgttttgaagcttgtttactgcatcgtatgtaagtacacttcttcaagctgacacttttatttgtcagactttgtgccaaatttagggcagtaactcgccgggagaaactgcatccctga

SEQ ID NO: 14064 - DNA, 839 bp, Zea mays
tgatagagcaagagctcagtagaaggggaagaacatagcaacaagtagtatcgagtccctatctacccaggaaggaatgttaaataagctctacaaatctacttagaaaatttctcaaactgtgtggtttgagtaattcaacaaattgctagatctttctaacgctgacatagatgaagatacgaaaaggatccacaaattggtcttgaaagagttgacagagcaacttaaattagaggatgaagaaacggtggaagaggaagatgagaaagactagtaatttattagctatatttatgaaatgtatagttttattttttttatgtttaagctacatatttttaatttttttatgaattatgtaagtttgtttgtttaattatgtaaccatatgtattttttcaataaaatgatgtgttttatgttgactaaagtctgtaaaaaatgaggtggcaggtggcagctgtaagattgtattgtaggagtttggttgatgaaaagtactagacgactgacagcttcacccccatgtattgattgattggttggttagttgagcagtgtattgctgtttcttccaccagctctgccaaacttctccccaggttcacatggagagcgagtattgctttctcctcgctcgttcacatgagaattgagacatggccaccggcctcttcccattctctcaatgtcgtctgtcgatcagctgatcgattcttcaaagcaaatgagcatccatctttcatcctgtgctgagctcgatcgccgtcgttcagctatcgatctgttgatttcatttcattcaacaacagcagcacagcactgaagcaagctag

SEQ ID NO: 14065 - DNA, 55 bp, Zea mays
ccgccttaagttattacggttgacttgattcaactgatttcacggagcgccctgc

SEQ ID NO: 14066 - DNA, 1500 bp, Zea mays
gatattaatatactccagcaaattctaagttgtacatcaaaacatattactttttattgcatatattttaactaggtaaaaactagagacataaaagtggataaaaatatattttaaattatctagttcatcccgtcttctcttctaagacgccaccttcccccttgagagaatcagggggcatcagctccgaaatgccatgcagcggtaccagatcaacggtaaaaacaccggccagccgccgtcagatcgtgcagtcccggccacggccgccggtaaactttcccagaaggttacaatacaatagggcaatgggccgagcgtctgcgcttgtttcggcatggatggaccagtgcctcgacgacgcatctgatgacggctggcgtggcacacagctccatccatctgcgcgcggtcgactgccgtcgtcagctacagtttcgcgggcatgccgcatggcccccccccgcccggccgcccgtctgacagcaggatgcgtgccattgcttgcatttgcatagttgtgtgccccgccgggggacctctgactcccatccatatggctgccatgccatgcatgcacgctgtgttgctgttgctcgtggcattcaggttcggggacgacggtaactacagccgcgcagcgacacagaccttgccaaacggccggcatcggattgcggtgcctgctgcgtatgcatggaccgtactcgtcgagtagcaggaacaacttgtctgcactgtcagacacgacacccgttgtacagctagctcgctatggcctatagcggactagcggttgtggctcccggcagcatggcaccaaccgacgatggacaattctgtgttgcaactgtgggagctgcaacggccacagtccatatacatgatacatccccggcgaaactctcacctgcttctgtatgctcactgaagccttttacccaaaaaaaaaaatcctagaaaacccgtgattagctcatcgtccaatttaacttgaccgaacgatccatgtcgcagtgaaaaaaacaccgaattatcctatatgcactaataaacttgactcaaagctaaatttgaatgccagtatttgggtcgctttgtgtaagactttgtacttgtgcttatatacacatccaaaaaaaaggagattgtaataatctcgcagtgagaatttacggcccgttctttcccatcatttggggcccatctgagaattctaaggcccatcccgccggcccggctaccagcctactcaggcccttcaatctcagccgtgggctggatccgacggcaaaggcaagcatcccccggccgccgccattccaaccatccgagcatcctgctcagctcagggcgaaacaaaaccctcctccctcactgccccctcgcagacgagacgcgtggtagctagggttttggcctcgccgcgcacgcctcctgaagcttctagacgttcgaggaggaggaggggaggctcccgccgccgccgccgcagcc

SEQ ID NO: 14067 - DNA, 861 bp, Zea mays
tcggtacccctgggaccccttatgaggattgttatcaacggcacggatatggtttgcctcgttatttcttcccctgaccccactgatgtgggagccgccagcactaaatccgtccttatcttgacaggaagacttccaaatcgccctatgaggtgactaagcttttgctggcttataaaacagagcccaaagtataagtccaaacgtcaggacattttttttaaatggagcattcaattccgtgtcaaagattgcaattgtgcataatcctgtactaacaagggcaggtgaaagaatatgtagatgggtggtcagaacagcgtgatggaaagttattttcttgttctttgcaaaggtgaacaactcacgtaaagatagatactagccaaagatcctcacaagaatagcaaaatcaaccatatgccaggcagaaccctcatccttgggcttgcagttgcagaacatatgccaagcagcatcttgtgttttttgtcatttaatgtcagaccctctccaaatgcagtgctttctgtatttgtgtatctcctccagcatggttgaatggactttcaaagtgcaaagttagaaagttggcaggggtgagagaaacgaattagctctctggagccatcctggctgggatataaaggaaacactataaaaggcctctgttcactaatggcagtaatttttcaatctttctgtattgaataagattatgtcactgaacattgtgtttgttaaacaagctatggtttcttattttgaaattattctaaggctgctttaaatactagttatttgcttgtgcttgttcctccttgattattgaactcagtccatgtctaattatctgcagac

SEQ ID NO: 14068 - DNA, 1500 bp, Zea mays
tgatagcgtagcgtgaaattttcgcaagaaatgtcgtgattgatgactaggtccctaaaaaataaaaaattactattttaaacccctattttatgttttctggaagattttgcggttttattaatctcggccgacctccatcggaaatatatgtcatacaataattttaaaaaatcgatccagcatacaataaattaaaaaagattcgaccacgatgggactcgaacccacaatctcccgctccggaggcgagcgccttatccattaggccacgcggtcatgatgcgtagactctctgattaaatatacttgactgtaaaacataataaaattgggctttggtaagagaagtctcattagcccataagagtacattacaaggcccaggatcttcgtgctggtgctgccctgcttgtacgtaccaatacgccgacggtcgacctccgttttcccgtcctctagctctggatttgtgaattgtgatagagggaggccggtgtggtggtctggaaacaccatttcagctgtgggctccatttgtacttgaggcctaggacacttgggacacatgctagctgtacgcgctgtcaaccgtatattattaccggagaagaaggctacagtacgtacgtacatttgtcgttgcagcactcgatcttatctctatagtttctccgagttttgtaaggacgtttgtggcagacataggagtagttcttcctaatccattgtatttaaactttttatttagatctctcggattaacttttgtaaaaagtctaagttgtaacattttcttttcttatcttcaataaaattctcagtaggacccccttctgattcttaaaaaaaaagttttgcaaggacgttgcatcattcatttcgttttgccagtgcatggctagaggtcgccagtagcggcggctggggatggatttttctttcttgagacagcagtgcagggtggacaggggtagggattacttgtgcagtgtggtaagccccttgtgcgaaaactatgaacgacatggaaactagctagagttctttctgtatttgtaaagccttcgagggtgtgcatgtcagacgtgctaaatggctgtacgtacgttttccatatccatggctgggctgaagccttgtgtctgaaaacttgtctactgtcggtgtgtatcggagagcctcttcttctttgtttaggctagctgatgccttcagtgctgaaaagcatgcaagtcttgtaaaacaaaaaaagagaccggccggcacatcttacaaaaagagcggcatatatatatgcactcaagaacaagttgcacagcacggcaggcacagcatgtacagctagctagtagttcggatctagcacgtacgtgtggcagaagccgtcgtccgatgcctcctaccagtatatatacatacatacaaaggggagggatggagatcgacagcactagatcgagagctgagggtcgatcgatcgagagctagcggccagcc

SEQ ID NO: 14069 - DNA, 453 bp, Zea mays
ggtccgtgctcggacacccaacccccaacctccgcgacctctacgcgctcgggaggaagctcgggcaggggcagttcggcaccacctacctgtgcaccgagctcgccacggggatcgactacgcctgcaagtccatctccaagcgcaagctcatcaccaaggaggacgtcgacgacgtgcgccgcgagatccagatcatgcaccacctatccggccacaagaacgtcgtcgctatcaagggcgcgtacgaggaccaggtctacgtccacatcgtcatggagctctgtgccgggggcgagctcttcgaccggatcatacagcgcggacactacagcgagcgcaaggccgccgcgctcacaaggatcatcgtcggggtcgtcgaggcctgccactcgctcggggtcatgcaccgggacctcaagcccgagaacttcctgctcgccaacagggacg

SEQ ID NO: 14070 - DNA, 197 bp, Zea mays
ggtccgtgctcggacacccaacccccaacctccgcgacctctacgcgctcgggaggaagctcgggcaggggcagttcggcaccacctacctgtgcaccgagctcgccacggggatcgactacgcctgcaagtccatctccaagcgcaagctcatcaccaaggaggacgtcgacgacgtgcgccgcgagatccagatc

SEQ ID NO: 14071 - DNA, 235 bp, Zea mays
atgtgatcgatatccatacgtccgctagtgaatactagtgtgctagggaacgaatagaagacgcaatgaaaccagtaaaagaaaagcttgtgttgtcctgtcgtggcagggccggtggcggtgagcgggcccggacctccctgctttctggggccggccggtcgggtcagttgccggaaatgcccccgtggtagactagtagactgtagaccggagcagagttttggacttgacg

SEQ ID NO: 14072 - DNA, 649 bp, Zea mays
caggtgaataggatctactatggaagttcgcattcttgattttagtagaacccgccaaggtacataaaaggtaaactacaagtttattatatatcttgataaacgatatacataatttgatacggatttgaatatttttgttcttatttgtaataatatcaaaagatcagccccaaatttgtttattcaacttggccaggccaaggcgaacatcccgagtcatcgtcaacgctggggttgagctggtattctggtcccggtcccttgcatgttccaccaccacgcccatggtctttggcaccgggcaccttcctggcttcctcatcgcaccatccgcagcaaataccacgggaaacacagccaccgtttcacagttcgcctcgcctcgcctcgcctccctctcctctatataaccagcgggtcgcttcagctcgccctgacctgtccacagtccaccatacatatcactctccgctccgccattgttgctccttattagtagttcgtcccgcgtcccttgacagttctatctatccccaccacaaataagagaccacctctctgccttcttctcggaggtcggagaagagctctctgcttcattcggccggtccaactccaccgaccgatccaatccaacccactgacc

SEQ ID NO: 14073 - DNA, 1125 bp, Zea mays
agatgaatctgccaatacttttgcaactcccattcgaatgactctaaagaattatcaagtactacttgtgtaggttgatttctattctattttgttcaggcttcatagctggcaacccttctatgttgaattgttgatattaggagtatatttacctattcttcatatagtttaacttttttcataacgacatttccatgtgtacctctttatgcaaactttatctatgtttttcttattattttaatcggcatgcccccttattttgctgaaatcaatcgttataagttataacactgtgatcagctatgcaaatgttcaggtgaatttgagtcccatctggactctgaaagtcattggataatatgcatctaggccagaaatgaaattggattgttatttcacaaggctaatgattcacatttcacaagcacataatacatggacctatgtagttcctagatgagttagttcatgcatgtgcatagcttacatgactacaagtctgcaaatatatgtagacaaaattaattagttgacactacatatccttgctatcctgatcttactccctctattttgcaataattatcagcatgccctgtgtgagaacaaggaagtgttaacttcaagaaaataatgtgaaatgaccaaccattaatcatactcctatttaatgtaactatatagaaccatacctcctctatttgagcattcaatagacactgcaactaaaaggacttgtctgttttctttgcaacatcagctggtttgcttctctttggctgggtcttgtttgtcaggaacatttctttttcgcaatttgtgaggaatacacacattttcagaggttcaagagttttgctacataactgaatttgttaggagcacacatttcagaactggatttttgagttgcacacacatttcttttgtttcagaactgaatttttgaggtgcacagacatttattttatttcagaattgaatttttttgttttagaactgaatttttagtgaagagcacacatatttaatagtttcggagcacgacattttaaaactaatacaaaactgaatttattacagttatacatggttgttcagatgtgacagcaatgacta

SEQ ID NO: 14074 - DNA, 213 bp, Zea mays
ggtactgcttctctgcattaaactcattggtagttggagacttggagttccaaaagctcccttaggctgtctagatcctttatttagtattgctctatattatttaatatgatatttctgtttcacctgtgttttttggtaaaatttatgtgcttcctgaggtgtacaattcacttcaatgttaataatcagatgacaaacactgtgacaagc

SEQ ID NO: 14075 - DNA, 766 bp, Zea mays
ctcaagtgatcaagaaagattcctctctccactaccttttggatccgttcgcattttgcacatcggcccatctaaatactcacatattgaacgcgtggaatagcatgactcatgctgccgcctctgtttgcacggcatgaattttcccttcattcacaaactcgaagccatttctattaactatgatctcgtagaaagtcaaacaacctgctcttccctaccgcctccgtttgcacgtcatctacagactactttatactctctttaattttcttatttgatgtttgtaattgtaaatttgtactgttcagctttaaataataaatggagatactaattcgtatgatgtttccgttgcatgatgtatatatatttattttcctctaaaacattccaaactccatgtttctcctgtacaaagaaattccatcattttgaaaaaaaaggaattcgatttttattcgttctagcaaatttatcatgcaacacgtcacactcacaccgaccctgttcagttccgtcaacttcccctgagcacgcgcaaataaaatttgaccgagggccttaacgcaaagtggcgggacattcttcttcgcccagcctagccacgtccacgtccatcccgaggcaaacgaacaaaggcacagcgcacctcacttattacgaaccccctctgtgccactgcccactgccacctcaaatccccgcgaacctatcttttccttcccccgatccaggcggttctcttcccagaagccagcccaga

SEQ ID NO: 14076 - DNA, 237 bp, Zea mays
gcccctgcgggccagcgggggcgcacgagcgagcgtgcctgcggatgccgcgcgcatgcggcaacgtttctgccggaaagcaaagtgcagtcagccacctggatcgacctgagctgtcgattgtgccggcgccgcggcctacctataaaaccctaacgaccttcgacgacggcaggcaccatgtgtcatcggactagcaagggtcctctccctcgcgctgtgcagtgtcaacaagcc

SEQ ID NO: 14077 - DNA, 678 bp, Zea mays
tcacttcgagcggttaggctctaatgaagcaccaggctttgataccaattgaaagtcgcctagagggggggtgaatagggcgaaactgaaatttacaaacttaatcacaactacaagccgggttagcgttagaaatataatcgagtccgagagagagggtgcaaaacaaatcgcaagcgaataaagagtgtgacacgcggatttgttttaccgaggttcggttctcgcaaacctactccccggttgaggtggtcacaaagaccgggtctctttcaaccctttccctctctcaaacggtccctcggaccgagtgagcttctcttctcaaatcaattgggaaccaaacttcccgcaaggaccaccacacaattggtgtctcttgccttgtttacaattgagatgatcgcaagaacgaatgagaaaaagaagcaatccaagcgcaagagctcaaaagaacacaacaaatctctctcacttaacactaaagcttttgtagaatttgggagaggatttgatcactaaaccctaaaccctaaacttgggtgtgtctagaattgaatgctagagctcttgtaagtagttggaaggtggaaaacttggatgacttgaatgtggggtggttgggggtatttatagccccaaccaccaaactagtcgtttggtggaggctgctgtcgc

SEQ ID NO: 14078 - DNA, 1500 bp, Zea mays
ccaagcattcctacaacattcctaagcaccaagacatcgatctcacgcattcgtttcatttgtgatagcatttagagctcttgttgagttgcgaactctttgagttatgttgcgagctcttgttgcgacttgtgtgcgtgttgttgctctgatcttttgaagtcttgtgtgcgttgctcattccccctttgctctgtgttctttgtgaacttcaattgtaagggcgagaggctccaagttgtggagattcctcgcaaacgggattgagaaaaacaagcaaaacaccgtggtattcaagtgggtctttggaccgcttgagaggggttgaattgcaccctcgtccgttgggacgccacaacgtgggagtaggcaagttttgtacttggccgaaccacgggataaccactgtgtcatctctgtgattgaattcttgtggttattgtgttttgactcctctctagccacttggcataaactgtgctaacgcctaatcaagttttggggcttaaagttttgaagttttacaggatcacctattcaccccccccctctaggtgctctcacatgtccggtgcacaccggactgtccggtgagccaacgaagcaacggctacttcgcgccaacggtcgactgcaacgcattaaatgcgcgcctgcgcacgcagaggagcagtgcacgcgcgggtggcacaccggacagtctacaggacttgtccggtgcgccaccggacagccaggcgggcccacaagtcagagctccaacggtcggaacccaacggcctagtgatgtggctggcgcaccggacactgtccggtgcgccatgcgacagcagcctccaccaaacgactagtttggtggttggggctataaatacccccaaccaccccacattcaagtcatccaagttttccaccttccaactacttacaagagctctagcattcaattctagacacacccaagtttagggtttagggtttagtgatcaaatcctctcccaaattctacaaaagctttagtgttaagtgagagagatttgttgtgttcttttgagctcttgcgcttggattgcttctttttctcattcgttcttgcgatcatctcaattgtaaacaaggcaagagacaccaattgtgtggtggtccttgcgggaagtttggttcccaattgatttgagaagagaagctcactcggtccgagggaccgtttgagagagggaaagggttgaaagagacccggtctttgtgaccacctcaaccggggagtaggtttgcgagaaccgaacctcggtaaaacaaatccgcgtgtcacactctttattcgcttgcgatttgttttgcaccctctctctcggactcgattatatttctaacgctaacccggcttgtagttgtgattaagtttgtaaatttcagtttcgccctattcaccccccctctaggcgactttcaattggtatcaaagcctggtgcttcattagagcctaaccgctcgaagtg

SEQ ID NO: 14079 - DNA, 209 bp, Zea mays
aaaacaattcaccgtgtcatccgcttatttcttggtggatttgtttttgccctctctttcggactcgaaatttaattctaacgctaacccccggctggtagttgtgctttacgtttataattttcagattctgcctattcaccccctctaggcgactttcaattggtattagagcccggtacttcattagagcctaaccgcttgaagtg

SEQ ID NO: 14080 - DNA, 1069 bp, Zea mays
ggttcggttgaaaaagtggagctctcgtatcatacgaataagagcgtccaatttaagagtgtcggttcccacacttctatacgaataagagtgtccaatttagagggtcggcttatttcagtaagagtgtgagtttttggtcgacaatctttgccttttttcttgtagtgaggttaatttgaaataactgtgatgagttatttgtaaaaaaatgacgtggtaggaccgttgaaactgttgctttaatttaaatatagtatagatatagaataggcaaatccaatagaattgtaatgcctttttaaaataaaaaaaactttatcagaagtgcggtatatatatatcatgccccgtccattgctgctcccgaatcgaaacgagccccaatcagctacctcctcccggattccagtctttaggccggctcgaggtgccgcgcatttcaacgggtctcgcatgggggtacgttgcacttgcactgttgcagcagtgtcgctcctcttcttgggttcttcctctttcccaaatcattttatttgtatactggccgcaattctttactgtctagtcttactctttcctcttgcctccgcaccgaagcagaggaatagtagtgggtcggtctggttggccggtgctggtgcgttaatggcggttgacctcttcatcgatgcctcccggcgcctttaaatcgggcgggacgaagcgtctcctagcctctcgtcgcctcagctccctcttctccccgtgaccgaaccaaacactgagcggaagaagcttcgaaccccttctggccatctctcgtcctcctttcaattcttgagctttgtgcttccatctcctctcctctgttctcttctttgtctctgcgtgcctgttcttgtcgtctcgctcgatcgtaaggtttgtttgccatcgtactagtaaacatcgtgcgtgccttctcgtttcgaatcctttatttctctacagaaagaaagaaaagcttgagtatcttatctatcgctcggtcaccaaccgtgcacatgtgcggccctgggttcttggtgtgcagtgcaacggaataaga

SEQ ID NO: 14081 - DNA, 492 bp, Zea mays
tacttgcctcctgtgccagtgccagccagtatagaaattgagacgacgacgtcgacggcaacaacagcggtcaccaccacgccgcgtctcaatcccgttgggtttcaggcgccataactccagcagtcccgctgcgagtgagggggagccggtggcacggctgggctgcaacgatccgtgtccccccgcgtcctcctccttcctactgtgcggtgccggtgccgctgcccccaattgctcgcgttgcttgcgtcccttggcgaccaagttacatgtataaagccatgcatgaccagagaagaacacacaactgtcctggcctgtccacggtccacacacgccttccttatatcggcgctcacggttctataaaaaaaacacagtacgagcagagcaaggcggccgtgagctgagctgagggaaggacgacgtacggcacagttgctagcccggccgccggagctctccgtgatctgggccgccagcaacagc

SEQ ID NO: 14082 - DNA, 193 bp, Zea mays
tcgtgtccgttcgcttgccccccgaatcgtggttaggatatgctcatatgcatatgctacggactgacgtggaaaacggtttgactattttgcccccgccgcgtgagttgccaaacgatttccgagtcttctgacactccttgccgccgccgccgccgcctgccgcctgctgccgacggcaatagatttgggg

SEQ ID NO: 14083 - DNA, 193 bp, Zea mays
tccccaaatctattgccgtcggcagcaggcggcaggcggcggcggcggcggcaaggagtgtcagaagactcggaaatcgtttggcaactcacgcggcgggggcaaaatagtcaaaccgttttccacgtcagtccgtagcatatgcatatgagcatatcctaaccacgattcggggggcaagcgaacggacacg

SEQ ID NO: 14084 - DNA, 553 bp, Zea mays
aagatctattagagaaatgtttaaaatctacccacactaattttttagatgtccattaaaactgattttcaggagttatttgctgggaagctcctctaaccaagcagaatatcatctaaggcgtgtatggagtaaagtacagccatttttttgggatagtcaatgaacttagccgctaagaaaatatatatttatatttatttatggcagtatttagggaggaaagaaagaagaaatagactcccatgcagttgtccgttcaaatgcaacgtccagagaagaaaccgatgagcagcgagccagccatccttttctagtcaagcatcgtcagcgtcgcaaccgtccgtccgtccgtcccaacaaggccagccgccacctccccagctgacaggtgagccccaccccacatctcccgccacactatttataccttccctcccgttggcatcctcccactcgctcaccatcagcgatccttctctcttgagtgtcctcccatctcatccaatccatccccgccaccacaggcaaaggcaacccaaaaggagccgcc

SEQ ID NO: 14085 - DNA, 903 bp, Zea mays
tggctgctcaggctgtcgcggggaaagcgcgcctacggggagctggtggtttataggagccgtgccggcggtggagctggcctttggggaaagcagaggatgggaggcgcgattccgtttgccattcactggctgtgccatcgatgtgattcccgctttttttcttatttccgccaattatacactggacagggcttggacactgggctgctaaagtgtggacagacagttggcccaaacatatgtgcttctcacgggccggcccatttgtaattccttgttctgttacattttttttacaaatggacttgacaaaaccaagttctcattaaaacttggaacttcgtttatatacagggctgaaaaaaacgtgaataaaattcttttagtgctagtttgagaacttaattttactaaggatttatattttttaaaataaaaaataaaataattttctttacaaaaatgaaaatcccttataaaaatagagttcacaaactaatctttagactcattaaatcttggaacttcgtttatatacagggctgaaaaaaacgtgagtaaaattcttttagtgctagtttgagaacttaattttactaagggatttatatttttaaaataaaaaataaaataattttctttacaaaaatgaaaatcccttataaaaatagagttcacaaactaatctttagacgcagtgtacgctaatgctaaattcttttcataygcaatgctaaaatgggccgaacagtggcaaagattggcccaaatcgtcggggtttcacgggttcacccataaaactcacacgtctaccaccacccgagcgggcccgaactccgtcacaacacgcaaaaccctaacccaatctcgtttcccacgtctctcgctcccagtcccag

SEQ ID NO: 14086 - DNA, 381 bp, Zea mays
ctgccgtccgcccgtccccaacacccactgacccacacccaccccactgcgcattctcacacacacacaatacaggcgacttgtcctcggcgcctccgcaccccatttccctttttacgcctacttgacccggcagcgttcggtgacgaaaaaaaaaacccaatcgcctccgccccctcccctactccgggcgcagccgccgacgtcgccacgcgcattccgccgcgccaatcggtagggtttgccaacttcccccctcagcgacccgatcccgctccctcctctcgcgcgcattgcatctcgtcccgcttgtgtcgtttttgagctgattaatcccgtggtgggtgggctgtgtgacagggtacacgagcagggcggggg

SEQ ID NO: 14087 - DNA, 180 bp, Zea mays
gcccctgcgggccagcgggggcgcacgagcgagcgtgcctgcggatgccgcgcgcatgcggcaacgtttctgccggaaagcaaagtgcagtcagccacctggatcgacctgagctgtcgattgtgccggcgccgcggcctacctataaaaccctaacgaccttcgacgacggcaggcacc

SEQ ID NO: 14088 - DNA, 1500 bp, Zea mays
tttttagccttcaacataagtcgttctaaatttattctatttaatagttattattgtatctatttcttaacaggtagatgaagtcccacttagaaatattatgcagagacatcaccattggaattacctccaaaaagtggttgcacataacagtaacaatattattctgctattgattgaattgacaacttccatcttcactaattttttacactcccccacttacattataggattaaaaaatagaggtcaaggcacaatgaagattagagcaatgtcagagactaaacatgtgcaaggctcataaaaactaggaaatatgcatagttagtactctctctgttcgttttaatatgacgtcacttcacaaagtaaaagtgtttttttaaataacaaccttttacaaactttatgtggttttccatatttacctctcctctttcgacacattgctttacttactgttagacgttttcatggacaaacaaagaagatataaaggtaatattgttaaatctatgttttcttaatttaaacgacatataaaaacgaatggagggagtagcttttaaaacttcctttataaagaacttatagttgtcttttattataatacaatgttttccatcatgttaaatgtacagacatgacatgatatgcctgaaatatgttcctaactttagttcacatagatcgttggcaacacttttttaaatgcaaggtatgaattagcattaaataaaatgcaaggcatcatgtttatgggactattgcatataaataatttttatatatgtatccaactgttattaagctatctattgttagtaagcattggcgacttgcacaacttataaattattcagattttaaatttgtagctaaaaattattctaaaattaaaatattctatgtgtctacttatttcagaacggttgttggggacagccttgccgcttttggtgacttccgacgtccgtgtccgttgcacggctgctttccacggaaaaaaaaaagaatacttttaccacggcaggacaccggtaaaacaagagctgggccggcagacggccaggggcggggacaggtgcccagacccacgggattctcacgcatcccgaacgcggccacgctcgccgcgggcacacgcggcgcgctgtgctcacccctgtctgcctgcgcgcccggcacgcccgcgcccactcacgcccggccctgccccgcgccctcatcgtctcctcccggcctcccctcaaagcccaccaccgctgcccccacgccacccaccccaccccacccccgcccctaccgcgcggtgcccgagacccagaggccagaccccggctacctttcttcacctccttcccatcgcaatcgcaagcccccggctccggcgctcggcggtcggccaggttcgggagatcacttcgtcgcggcgaggagggagggggtcgccgttagcgcgcggcacttggatgagaagggcagcggtggaggagg

SEQ ID NO: 14089 - DNA, 593 bp, Zea mays
ctgaattcgcttcctctggcttgctatcctaaatttatgagaaaagcaatgcagagaagaagtgtgggtcgttctatgcgtttccaagttgtgatgtcgggctgggagacggtcgcgggcggtcggtggtgggcaaggcaatgacagcggcgacggccggccacgtcgacttccccctcctcccgcctgcctataaatcgggcgcgaacgcagagggcgccatttataggcgtcctgctcttttagctttggcagccaatcgcctcttgtcctgtcgtcgtctcttcctttcgcgtgagcagttcaggcgttcttgccctttcctcgctcaggtcaggtggggataggatcgtgacgtcgtcatcgccaccaccacccccagcatcccgagctgctgctggcggtggggcaaccgcgtgcgttgctagcttgctcgatctgcctctcctctggatcccctgtcctgtccctgttaatcgcgcgcgcttgcctatttacaaggcgaaacaaggtgagtggcgtggctccttgtctttctcgtgactccggacctctctctctctctcgcgcgcgctcgtgcccgaaacgctgac

SEQ ID NO: 14090 - DNA, 1500 bp, Zea mays
ttagacttacagagcttgagccgacgagtcaatcatcttcacacataagcacttggtccttgttgtcgatgacgaatgtcggcttgcaccactgctcgccaccgtgcaacctaccgatcacctcctcgacgaagatgttattgatatcgagtagggtctggacggaaatcgccacctgagcaaaatgctctggcacgacctgcagagccttccgcactacctcatgttctcaacatcaatgacgttattttcaggtagatgcagatcatcagcaagcccgatgatatagttcacaaaatctttcaccttctccacctctttccacaccaaggtgcttaactcatgacagagttgttgtgcgttggcctcgctcacccgctagatcctgacgcggattttcttaatcaccctctctagaagacctgctagcatattgggcaacatgaagcacgagattgtggtgaatatgccaagcggtcatggcggtagacgatctcctcatcttcctctgactcgataggataccaccatcctgccacctccaagttcgcctacatagttggtacgcgtgagtatggggtttgagtcccgccggcagatgcctctgcgatggtgcggtgaatactaaccttatgactcgttcttgtgcgacgctggcgagggcaagacatagcaacctcgtcaccttccatgaccactttctggcagagcagtgcgacgatccacccttgactcatgcagctctggtaccatatattatctagaactcttctccaacataattcaagctctgacgagaatgaatcgaccaccacaaactttgaaggacatgatgaatactataatttttttattgtgtagccataactacttttattcttgtgttaactgctaagccatctatctatataaatctcaaacctaaaaaaggaaaaagaaaaaaaattaaaaagaacacgttcaagagaataacgttttaaaacgagctgagttcaacgctaccttaaaatgattaaagatattaggcagaatttagaatcacccctctaacaaccgccgaaatgccaatccaatcaaccaatccctccggttccctcatcggatgggagcctcaccatcagaggtccgagatagctcacctgctgccaacagatcgcttgagaacggcgacatgggtggtgtattttatactggcattgccacccccaggccccagctagtgggcagggtcgtcgatcgacagggtagaaaaggaggcgaggagcctgtcagcctcgtgttccccctctcgttccttctgcctgcctgccatagcacggcggctccacaacccctggcggcctggccttgtgcttcgtgcgtgcctacccccctataagtacgcggcaccgtctcgcagacaccttgcagaaccatcactagtgagtagtagtgagtgacctgcaaagacacgcgaggcacgcagagctggagcagctgatctgagaaccaggaattagg

SEQ ID NO: 14091 - DNA, 256 bp, Zea mays
agtgagacatggcacctactccaaataaagctccaatgttcgtcttattaattggcgtcttgtggtggctgtactggcgaccaaaccattgggaatgcagaacattgttcgtcataattcatcccgagtgaagtttatttttggtttgaatgtgccagtactaattagctgttttgtgtcataattttataacttgttgatattatattaaacaaaggcaacatttgtatcaaaattataaagtttaaaaaaaaac

SEQ ID NO: 14092 - DNA, 570 bp, Zea mays
agggcgacacagaggagggcgccgggatcgtgaagatcgccggcgagggtgggacggaggaggaggcacctgagcgagaaacaagggggcgggcgggaaatacgagcggactagcgggggagccgagtggatggrygggggaaccgagcagacgrgcaggagagcctagcggtcgcatggctccccagtgtttttctttttttggttattgaatctctagaacttttcccaacattatttgtaaatgtaataggtagttcgtgtctagaaactcactttcagtcatagtttcagtgtcctcgctgaacttcctgcagattgatcactagtgcaaaattgaacgccagttactagtgaagtagtgatttatacttgtgcaccattactgtcacagcaatggccaggccaataaagttgatgaaacagcgtcacacagagcaaatggaacacttctaaaagcattcttcttcccctaattgaactttaccttgtggctgaatagaaagcaatttagtgcaggcgtccatgttgatactgttgtcatgaatcctccctttggtacacgaagga

SEQ ID NO: 14093 - DNA, 331 bp, Zea mays
accagcttccaggcaatgtgcagaatgtactcttgtatgcggggttatatgttatgttgtaaggtaaatgtatattatgtagtcacaagtcacaaccatcaaccgtggatcctggacctgaacaggagaatgtgtttgcttgctatatatgaaaattaggtgggtatgttgaagttgaccctgagttcgcaagtttagctttcaactttgagactatctcgctgaaccaaatatgtaaaccagctggagagttgagccagaggacacgtgctagttagctgttcttctcgtgtctgtatttctcagactgctctcaaagtatatttaatgt

SEQ ID NO: 14094 - DNA, 1232 bp, Zea mays
tagacaaaagataggtgttccatcatggaatatctccccttatttgtagaacttgtttggcacagcttattttcagcttcttcacatatttaagcagaaactgtgtcaaacagggagcttctgcattagctgtttctaaggtgaactaaaagcagacaataagcagaaactggttttcaccggctaatcagataagctgcgttttcaacatcagctgtgctaaactgggtcgtagacaacaaataagcttttcggtgtatgtgtcacctaggccttcttgggctacatgtttctcaacacaaacaattgcatgtaggtgcatgcactagtatttttttactgcacatacaggcccgtctagtgcctagcacaactgggccgatggcacagggataaaaattgtttgatgttttgcaaattaaactaaagaaccttgctttaaaatagataatataagagaacaatgatatataataaatcaaatttgaaagaactcattttagattgtttttatttctatatagtataggtcataagacctatttttatatttttgcaccggcccaagaaaataggagacggccctgtgcacacacatgactcatttatgatttgtttggtttctttagtcacctttctgaattttagggactaaacttaagtccctaaaatactatgtctgattttatcgactaaaattgactaaaacattattcctccgttccaaaatataagtcattccaaaattcttggagagtcaaagtgttttcaagtttgaccaaatttatacaatgaagtcataacatttatgatatcaaatgtataccattagatttctcattaaatatattttcatactatatctatttcgtgtcataaatcttttatgattctcgctatgtttttggtcaaactttaaaaactttgactctctaataatcttaaagtgacttatattttaaactagagggagtattatttacagtataagataatattttgtatgaccatacagcctaatctgcgcgaaaatagcaccaagaaaaacagaatgcaacctcgtacatatttttctgtttgtttttctccttgttgtgtgggctgggacctgggagtgggtcctcactcctccccctctctctctatcatcacccttcttccgccggaaggaaaagagaaaaacacacactctctttccgagctctctcgctgtctctcacccagccgccacc

SEQ ID NO: 14095 - DNA, 587 bp, Zea mays
caaatattaaacagaggatgtataccaaaaaccctaaaccctttatcaattcgtgacataataataatgcataataatggtccctctgatctgatgatcccgtcgattatctcgcttgcacagttgtacacgtggtccgtcgatgactcaagctagcgaaccgaagttgccaaggcaacatcaacttggacaacagattagttcgcgtcatgtatgacgctaacgagaagtttctttcacccatgtgcccggtaagctcgcccaggaacctgcctgggcgccgcccgtccggacttgagagctgaaaggtcaacaagcacccccaacccaaccatcatcaggaaatccctgccttgcgctgtctgagtacctaatgctgacccgcatcctctctcgtcaacagaccacatcaatatcaatactagtactaggattcatcatcagtagtatataaaatgaaccagaacaacctatctgtctgcaaatgcactcgtttcaggcctgacgtccgtctccaactcgactactatactaccgccgcgctctgctcctgcaccagccgggtcagctgaactgagcatcatatc

SEQ ID NO: 14096 - DNA, 598 bp, Zea mays
gtgtctactctaaaagcttattaagaaagctatcttgaatctagaaaaaataacgtaagagctaaacaaaattaaactttttttttgaaaacctcacctgaagtcaaacaggttctttgtcctttctttcgtgcttattttggtcattggtttgctcttgttgacctgcaaatatcttgcttagctttgttggtctgagtgcagaaagccagattagctgttagacttgctaccttgagaacataccctcagggcttgtttggtaaaattgactagcaagggaattttagcaccttcaatccactctaatccccttgctcccaaatatgccctcatcggtaaaattttctttcacttaaatagctagtctaccattttcgttactgtgaaccatatgactttctgactacatcgttaattagataagtattggcgaagcatatctgaatctgtaggtatagaaattacgggcaacgttgtaaattgaacttgctgrtcaacgtagtcgcagctcacaagcattttttatgtcagggttcttgaagggagcgcagacggaggctccacctggaatatacttgatgctcggaattcagaa

SEQ ID NO: 14097 - DNA, 130 bp, Zea mays
atgtacaggtagagtttttacctacccataccatgtaaagtttctcctgtaacagcttcattctagaacatgtctctgaattaaccaatagagttagcttattacagcttcattcttcacaacgctaata

SEQ ID NO: 14098 - DNA, 1324 bp, Zea mays
aaatcagtggagccagcctatggatggagtattgtgtgtactactccagtataagtgtttcagattcctgtggcgtcgtgagttcaagcatggatatctcgttcattgctgtcagcgcttggagagtggatttactgagttgttgggttctgctgactaaaatttgtgtcacgtcgggtgtttaaatattaattagattaattaaaaaaccattacacaacaaaaaactaaacaactagagtgcgagacaaatttataaagcatcccctcaggtgggatttcggtgccaaagatcatatcgacggtggagggggccctcggcctcggcgaccatggccgggcggtgaaggactcctagctcacgcttcttccaactcatcctgacagttgatgcttccttctcttcatcacaatcttaggttgrtcttcgagattctgaatgttctagattgtaggttttaggcaacgttctccagttttcatcagtcataggaaaatatattttggtatctagcaaacttgtgctgtataaattctttcatgcgatttctgcgagttttggtatggactgacatagcattgtttcgataggtaaacagactaaactaagtttacatttatactcacaacaatagatgatgtttaatcacagattttgccgtcactattgtactcacgccgcccgtcgccagagccctaatttgaagggtcgcaatttgtgttccgtgacatcgcacgggcacgttcctagtaatatataggtaaacaagcatgacctaaatctaggtttatggaccatttttaggaactactactcctattcttttttacttatcttttacttatcgtgttttagtttaaaaatatactatcaaatgacaaatattagagaacggaattagtaataatgctgcccgttagcccacagtgagcacttcttgtagcaaccaagcccatgcccatacgtaggctatcgtttagcacggtacagcccacagagaaaataaaatgaaaaggggggaaaagaaaaaaagaaaaagttcccgtcttcggtcttcccaaacccccaacatccatgatccatctcatcgacaccccctccgctctccttatcccttccattcgcccaaacccccgccgccgtgacccctgccagcccgcggccttcccctcgttctaggcttcaactgccggcctcgtgtcttctggtaagcatctacgcctcacctacggcgcgcacactctgctccgtcctggcaaaattggtttctgtttctgattttgtggaaagcgcgtccctgtggcagggcaagtgaagagagag

SEQ ID NO: 14099 - DNA, 334 bp, Zea mays
tgtgatacttggtataaaattgagatatagagtaaatatgatggttgaaaattgtgatatatgataaaaaaattattgataaggacaaaatatttattttaggatagaaagttagagttgtataagtgtggaaagtagggaaggttttgtaaaggtttgtgtgagggatttaaatgcaaaagcttttttctatggttgtctaaaggcatttttatgacgctcgctttaacttgctgcttgcatactagtcgtcggtaatatctcgagccatccggcaccaaatcttcctccacgccgccggctgcccggcgcccacaggatacagtccagagaa

SEQ ID NO: 14100 - DNA, 103 bp, Zea mays
aacctcgacaatcgaaccgttctttacttgagaaattaaaggtgaaactggttctggttcacagtgccacttattatagtcaacctgcaaagcatgtacactg

SEQ ID NO: 14101 - DNA, 1410 bp, Zea mays
tacgagtggatagcagaccatatattttgcaggtagatacaaatataagtggacaacatactataccagcaacacaagtgagagataaatagaaaatagtaagttagatacttatctgaatgatctcagctatcccctatccatccatcagactttatcagcagaaatggatcacatatcttaaatcacgaacaaatgggcagcagtacaacacatgacatgctacaattcataaatggcaaaatttgctggaggacaccattggcaagatgtaatttattaatggcaaattttgttcgaggacaactttgaaacgtgtatttggaatcaagaattcgctcactttcattataaattcatggctatttgcttctggacaccatgcataataaaatgattatttccaccgtccaaagagtggaaaccgaggatgtgtttggttgcttacaccaaggtggcccgtggtgatgaggtcagcttggtctactaaatccagcatatgagggtgtaggcagttagctgtatgtattgagagcatctccaataactctcaattgatactctcaaaacaataatttaggagtaaaggtgaaaaacttgttagcgctgatccaggcgctaatcactgcgttgagaaccgttggcaatgctctctgtatagatgcggacggtccgaggccaggggccggacggtccacgacttggtgcagtgctcaggatccctgactgacgggccggacggtccgtgcctagaggctggacggtctgcgtgtgcgcaggggtggcgaaagtcgctggcggcgcctggatctcgctcccgggagggaccccgttgggaaggagagatcctaggtgttgtctaggtttggcaggccgacctagattcgtctaatcgacatagagtcgaagagaagcggagaatttggggattggaaggctaagctagaactagactagaactactcctaaatgtacaagaaataaatacgagataaactggttattgattcgattgatgattacaaatcggtcgtattcctttttatttatagaggagggggctggacccgttacaaacaaactcaccgaactaattccgtgaatctagccaacaaacacagcaagaaactcggaatcctaatcggttctgcgcgcgcggaccgtccgaaccagcggcgcggaccgtccggcctcaatttggtgctcaacaccagtattaattaacagactatttcatcttttggtgtataaaagaaaacttgaccttctaaaatttgagaaggcacgggctactttgcaataaaagttataagtgtcaaaatatgagtcaaaaatatattgtaaagctaagacaaggtatctgatttgggctttgtttgttttagcttctggtcaccaaaagttgttgca

SEQ ID NO: 14102 - DNA, 452 bp, Zea mays
aatctgtgtgataacgattcattggcgtcaaaggacatctttgtataggggtgtgttagattggatgacatgtgaatgtgattcatggatcagcctggatgttctgttatgattaagaactgctatgtatcgtgcaatagacacatcgtctgtactttggatgttattatcaggtcccaaacttcattatatccaatatgttacaatatcattttggtgacttaactacaatgtcagctcgtgccaacagaaaaagaagaaaagaaatgggcggtggttgcccgacaagtccttgtcagccgcacagtcttcacacgaccaggggccatgagcaccactcttgccttagccacggcccacgggcagcacagcatctccatctatccaaatggcagccagcagccgtccccttcctccaccctctgccatcctcgcagtcacagcccctcacc

SEQ ID NO: 14103 - DNA, 825 bp, Zea mays
gatctcaatttttcacatcctagttttatatcagactcccatcttattattattttgttaggcgagaaacaaacatgttaacaaaacttggtccaaaacctctagaaaagcccatccagccatcttcatcaagcaacagcctagtagttttcatgactgaaggcctatccttaccatagttgtccataacctgaaaccacagaaactgtttctacaaagatacataatcacaccttcagaagaacaattaaatttacctgaagccgagtcttgatggtatctattggaaccttataccacagaaactatataccaagtgagaatgcgagacagtaggcagtagacttccggttcggggaggctacaggcacaggcagcaggacagctagctgattatttggaagcgcacatgtgaaccgttgataaatactcctcatcgggcaatacaaagggttggctagctagcttcaaagtccagtgttttttgtcagcggccgcgcatgccactctaaaacagagtggtgataatcgaccagcaagcacgagcagttgtttggtaaatcaattggtgtttccctaccaatggataattttattattaaagagttgtaggatatcacagatctaccagtgaacttttgaatgttgtttggatgatgtatcccagtaaatttggtaatataataatggcttcatagtggagaacagaagataaaaatggggaaaaggtatgtaaacatagtatacgaaatgaaaccataatgtgtgcacaggtgtccatcgctcacttgcgagctcataaccgtttggatcttcaccaggtgg

SEQ ID NO: 14104 - DNA, 1500 bp, Zea mays
ctctttatgtctctacaattgtgtttgaattagagataggagattgaggctgatttgcaaaaacaaaaccaagtggtggcaaagagtgatccatatatgccaaatttgaatcaaaacaattttgagttctcatttgtattaatgtcgcacttcttttagttgctttttgttgtgttggcataaatcaccaaaaagggggagactgaaagggaaatgtgcccttgggccatttctaagtattttggtgattgagtgccaacacaagtgcttaaatgtggatctatacccatggatggacaaagtgcaaatcaagagtaaaggtatgtttctaagccttagtacattgttttgaggactaatgtattgtgtctaagtgcttgaaacaggagaaatcgagtcagagaaaagttggctgtgtacagccaaaaggctgttcggtctggagcaccggactgtccggtggtgcaccggacagtgtccggtgcgccaggctgactcggcgtgaagtggccgctctcgggaattcgcccgacggcgtacggctataattcaccggactatccggtgtgcatcggactgtccggtgagccaacggtcggccgggccaacggtcggccgcgcgatctgcgcgggacacgtggccgagccaacggctagaagggggcaccggactgtccggtgtgcaccggacatgtccggtgcgccaacggctctcaggctgccaacggtcggcttcgttatttaaggaaggaaatcgggcaccggacagtgtccggtgtgcaccggactgtccggtgcaccagtcgacagaaggcaagatcagccttccagatttgctctcaacggctcctagctgccttggggctataaaagggacccctaggcgcatggaggagtacaccaagcaaccttagagcattcttgatcatccacactcagtctttgcgcattcgtttgtcattctcagtgattcgagctccgttctagtgagaactttgagatagtcttttgagctcgattcttgggccgtgtgtgtgcacattttgctgtggatttatgtgtgttgcttccctctcttactccgtgtttctttgtgaagttcaagtgtaagggcgagagactccaagttgtggagaatcctcgcaaaagggattgagaaaaagcaagcaaaacaccgtggtattcaagtgggtctttggaccgcttgagaggggttgattgcaaccctcgtctgttgggacgccacaacgtggagtaggcaagtgttggtcttggccgaaccacgggataaccaccgtgccatctctgtgattgatttattgtggttattgtgttttgactcctctctagccacttgacaattattgtgctaacgattaaccaagttttgtggcttaagttttcaagtttcacaggatcacctattcacccccacctctaggtgctctcaattggtatcagagccgttctcttcaagaaagggactaaccgcccgaagag

SEQ ID NO: 14105 - DNA, 486 bp, Zea mays
ccccccccccccccaaatccatgttgggttcctgacgttgatcaattttctggtcctgagctttctggaaacccatcgctgtttggttagctgataaagacataaagtcatagttgataaagatatgatcgttcccatctatttgttaaccaatcaatgttttggtccctgcattttggggtttgatatgcatatgctgaacccttttcatcctccgctaatatatgcatgcagtacagctcagctctacaggtaggcagcacaagatctgcttcctacctatatgattgcaagttgatccatcatacttaacctcatgccatgcacagcttttgaaaatgtttcctgtggatgtaactggttgctgtttcctgttactgtctccatcattctaacagttctttagtggtgacatcgaacacttgttcttatgctcactgtcaatcatgaccaggtcaactacaaggagatcttattttggttaca

SEQ ID NO: 14106 - DNA, 83 bp, Zea mays
aactcctccacctcctcgccgccwccgaccgctcctccttccccagcccccccgccgccgccgcgcgccgtgtcttcgcccac

SEQ ID NO: 14107 - DNA, 1500 bp, Zea mays
actaaaaggaaaaggcctaatcacgttcgggcacgtggatagcttctttccaagcacttctatccaaacacaactccattggaatattcaactccttcaagtcccttttggttgctgttagtactgtaatgttgctttttgcccaaggctttatttatagtctgagctaaagttagagggttctacgcagcctctctacaaaatgcatgggtaaaatttgtcttggtcattcctttcctagaccccccactcagggcctgttcggttagctctcaattcatatggattgagtgggtttaaattctaagcaaggcaaatttcttaattttttccaatcccatccaatccatgtgtaatgggaataaccgaacaaggccttatatgggagtgagtggggagccattagcattgggtatcttgtcctttatttataacctgaagtctgatcatacccggtaaacttgtgaaactatggatctgcatggaattcctatgttttgattaatatttaatatatactactatgccaatagctcattaactggtcctgtttggttttgggtgactaaagtttagtcacttttagttcctaaagaagcaaacatagtgactaaagtggggtgactaaactttagttctttagtcaccaagaggatgactaaaagtgactaaagtaggatttttactttatttgccatctccattttcttgttgcaccaaacatctactaattaatagggttaatacagtcattattcacaacmattaatgttcttttgtcaggtttagtcactagaaccaaacgtgatgctttagcgactaaactttagtaactaaactttagtctagtgactaggtgtgtttggttgcaatgacaggacgggacgggatgtgacgatccctcaaataaggttgtttggttcagggtcaagggttaggacaagactatccagtgttgtccccagttatccctcaaaattggagagacgagagggaatgatagaggacgtctctgtcctggctgtcccgcaaccaaatacaccctaaatgaaccaatgagggcctaaatattcccagtgttgagcctacatcaatgaacgagtctgatcaaattacagcactgatgttattctgaaattttgaaaatatcacaaggtatarcctatagggcgaatatagattgaaagcagggtatcaactgttgaaaagcaccggccaaagcgggcagtagcagagggaaacttttgaaaagccttttcaaaatttggagtaaggcactgaggcgagcgcgggtggcggccggcagcgaggaaggctactgttaggatcatctcgctacaaaatcgggttcccgaggtgagctccgcctcctaatccccttatcgatccggcatttcacgtgctttctcggtgagatccggccggattgggcgattttaacttctagggtttagccaagtgcacgaatctgagtttgcgattctgttctttaatgtatag

SEQ ID NO: 14108 - DNA, 615 bp, Zea mays
gggtggtgttataagaggtcggttatctcacttgtggtttcttatgtgtttgtttgggagcaatagaatataggggatgggaggggctaaatcgttttgcttgaatagtaaagagattttagtcccttcaatcatctccatttttatatggtttgtattaatcagaacatgattaccgcaaatactgtaggccttcaggttgtttgatggtggcgcgacgcaagagagaaaagagagaggccgcaggctaggtttggctattgtcgagtcgtctgcatgagagtgacgtggggctctagacggatggcgactagctagggtaacgaattctaaattttacactgtaaaatgtaagaatcgtatcggattaagatcgatgtctatttttatttaattttaaactaaaattaatcaagagctcaaataaattgtgcagaaatatttagatcgttgtccgttaccacactagcgtggtgcttataaatacccagcgtagtactaactctaccgcgctgactcggcaaatcatcgcctcatcttcctcttctcgcacctgcgaagtccccccgctttctatccccccgcctggccgcctctaagacaacagagacagca

SEQ ID NO: 14109 - DNA, 758 bp, Zea mays
gcttgcatgcctgcagttcgtgtgtcgtgtgcgtttgtaatcagtttggttcagttttcatatgtatcgaatagagtccagaaaagtagatatgtgtgtttgaaatcgcgttgagttcctgagttcactgtcttcaactctggcgaacaactccggcgtttgctagaacacttggcaggcttgattattggattgctggctattgagttttccaaagaatcgttcttctggtctcttcttttgaagaatcgttttctggttagatggtgtcattatacacttgccagcgaaaaatctccatccttcaagccttgttcgtttcatccaaatggtttggggatgaaatgaacaaggtctcagatttgttccatgtggttctattcttgtaagtaaattattcatattagtttgtaagacactgagacgtaggttccagatccaccatactttcactttgttctagagaccctccacctgtaattatggtttagtatttccatatggtattaaaatatacaagcatcagtactaattttatttgattggattagatcaagattctaattatctgtatagattactgatagattttactttattggattagattggattggttggggtccatttgctgcaatctgttcgcttaatttgatgacttcactcgattcgctaaattctttgcagaagattaaaggagccccaggagccccaactttcggaggacgacccagctgccttcaaagttcaaaatcaaa

SEQ ID NO: 14110 - DNA, 113 bp, Zea mays
taattttcctgacgtacataaatacaccgtagcaggctagcagcgcgctatggtcaaaacataatatttcagaacaagtccgaacgaactgaaggagaggaggaggaggagga

SEQ ID NO: 14111 - DNA, 1362 bp, Zea mays
gtcatttttaatgaaagttttatactcattaaacagggtgacatatcatcgtatttggtgacatgatattgcaattaagagaaggggtatagagaaagtttcatgtgagatggtagagtttcatggggataaaaccatgtatacacggttacatagtttaaatttgatgcgatagtattagaaacagtacattaaaactcaccactggaaataaccttattgttgaacataaaaacatattttagtgcatctccaagatgagttctcaatgggtatctattttgaaatatatgattctaacaccgaaaagttgctctaacaaaagttctatgcaacaaaaaatatcaaataattataggactcaatctctcgggtcctaaatataggaccccatatgctggagctctattcttgttttatataacatttataatattttattttctaaataatatgattttatttttaataacatgatatagaacttagctgttggagctacaaatgttttttgtggccttaaacactttaaatcagatcctaaattaaatataagacttattattggagatgctcatattatattgtacttttgtattagagcaagacggaagggtggctgtggatccttgcttagtcccaaagtttagcggttgacgtccttgatttcctatgrttgagaataaccagcgttgggtggggagcgtgcttgactttttaaaacccataatatctttagcttgctagtacgtacactgctattgttatggaaactcctttttttcggggaaccatcagcttcaccgtgcgtgaagctagctgagtgtgtaaagaatccgaggagagccgccaacaaattttcttgttctagaatttaggatgtatttacagagactgataagtgggtccactgattaaaggacctataagagaagcttgcagccgcaccattcactcacattcaccctgcccaccccgaacaataaacaacagcttcaccctcctcctccagtgcaggccgtcggcggctggcggcgtcatttctcctccttcctctggcctgccctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtcagctcttccaaatccaaaagaattgatttttttcttgtcatgacgattggttctttcaatccttataggttaattactctatctattaaatttctggaggtgcaggtaggtagccaagaagacatgag

SEQ ID NO: 14112 - DNA, 1500 bp, Zea mays
aagcctatttccctttcacctacgggaggtctacgaactcaggactagtttgatatgccataagtgcactatagaccgaggggtgtgttggccattaatgcaccgcagtctgaggggctcataagtcatgagtgctatgcgatccgaggtacttgtaggtcatgagtgggaggcggaccgacgccacgctgtagctcgatgccaggcgtagttaaatgcagtcggctatttatggcgagtcaatctagggccgggcgtgggatccactcgagtggttcccttcgaacatgcccgacctcctttgtcaggttccgccacgcccgaccctgggctcggtgtcgtggggttggaccgggagttaatccttttagggttgatgtatctgcctctcctaactaactaactaatgggccccagtgattacaggctccttttcttagtgcactatctgactggcgggtcctaggaaccaagcatcatttctccgatagtaatatagacacgatgtaagtgatagtcggagtgctagagggggctatgcacgargtgaggttgtgggttcgattttcacgggccacgtagccacgaatttacatgaaaaatgctgtgacttgcgacttgaacacagacaggtaggcagggcctcccctaaaagaaataacttcttttactattttgaacctcattttatgttcttgaaaaaggttttttcttcttttgtgtcttggactttttcttgatacttgtaagtcttccatgattcttctaatgtcttcttttgagatgttgcttcctcattaccttagttcaagttcactttgtatcatgtgaactataaatataaatactaccaaacacattagtatacaaggttatattgaccaacaaacaccaaaatcatatagttaaatgggctgagttctattttacttacagactagtctaatgcctgtgcagcctatattttttttatttatatactacctccattcataaatatatgacaccgttgattttttcgaaaactttaaccactcgtcttattcaaaaatattaaatttttattaagcataaactatcttaagtgataaaataaatccaaaaaatgataactcattatttttttaaataagatgagtggttaaagttcttttaaaaaatcaacggtgtcaatatatgaacggagtgaatataatttaaatattttttctatttaaatatgagacatcaccatgacaatgaaaatcgtggaacaatatagtatagaagagaaagagactgttaatattattacgaacaagccacaatataataaaaaaacctctaattccccagacccggcaagcgacgccatcgcgcaccagcgctgctggaccaccgcccgtctgaccgacgcaacccagccgtccagaaccgtcgtcgccgccgcagcccgtccttccaccacgcccgcgccgtcgcacgctccctagggttccgcagggccggggatcgccggag

SEQ ID NO: 14113 - DNA, 166 bp, Zea mays
ggtattgcttcccttagttaacgactcaatataagtttactttctgtcgattgcatgtacatttttgtgtaacccctcttcaaagtaggatgaagattttgtggcagacaaggatgatagtggatctccaaccgatgattctgatgcagaaggctctgatgctagt

SEQ ID NO: 14114 - DNA, 184 bp, Zea mays
ttgcatgcctgcagagagcgccacaaggtcctgcttcaaagactgcccaacgcccctcttctcccatgccgattgttcctgtcaccttcttaactcgtttgtttccctcctcttgagccactgaaacgtttacagagcgcttcgttctagcagcagcggacgagggagacaagaggaggaagag

SEQ ID NO: 14115 - DNA, 234 bp, Zea mays
atttggctatgtcatctgactctgactttgattctgacactgagtttgatccaggcagggaaatagttgagaacatcaagaatatctagaatcaaagcttcttaagaggtcggaacaaagaagaggagaaaatgtattgaatgtggtgaactaggccagatagccaaacattgccatggaggtcctacagctaaagagaagaggagggtctcttcttcaggaaatacaatagcc

SEQ ID NO: 14116 - DNA, 294 bp, Zea mays
acttacctgtttttttgtgcctctttgatattgattggtgaacatatagtttggatccaaaggcagttgaatcaccccctctatttgaagggccacctctacccagggaggttttgtgcacaatgccaattatcggaactgttttgaggattttttcagatatgcctatcaaggaagtatcccacatgcaaaatagggtttattgggccagattctgtaacattacttgcaaggaagagtttggcatttggaaaggcattttgctggcctctagtaaagttcggcttttatctc

SEQ ID NO: 14117 - DNA, 647 bp, Zea mays
ctgcagatctcactctataaaaccctactagtggactccatgaggcttcactctggagtctagagtctggagccggtagtacagcagtagcaaccctactcactactactctccactgtatctctactatcctcaagctcaaccagctagccactgtgtgtgtgagctcgtctctagacaacagagtgtgtgctcttgtgagagtgtgtgcgtgcgaaagtcagtgtgtgtggctctgtgtgcattgcctcgtcgtccgaggcagtactctactggccacaccgtaccgttcttggatccgaagctcagaagaagctaggcttctcatcaggttacaaaggtatgtgtaatggatgatctgataccacgtcacttctctctctctctctattggagattcgagttcgtaactggtaggatatggtatttgcaggtgattgagttcacctgtggtaaggaactggagatctagatcgctgctgctgctgctagctagctagcagctagcaccatcacttcactagcacaaaggccaagcagcagaggagtctgttgcgttctcgggagcgcgcgcgcccactgatcgggagatcgatcgatcggcggccgctagccccaacgggcgggtgaagtacgtgcatccatat

SEQ ID NO: 14118 - DNA, 124 bp, Zea mays
ggtactgtttcgtacatacagaattgtgcacagatataaatttcaagttgcagtttttttttcttgcagtattttctcaatctatttttgaagttccttcctgtgcagaaagaatttctggagg

SEQ ID NO: 14119 - DNA, 1497 bp, Zea mays
gtggtatagagtagatagttttgctgacgaggatagaatattctttttagagtacgaatttagagtaatgtgagtgcagatagcctaaggactgtagcaactccaatttgccgacacacgcagcccctattgctggcgagtactaaaatcatgacggtccgttaattgctcgccgtcgccctcaccgttaatcaaatcgacgaggcagtaaacgaaagatccacgaccgacacgcccagatcaataatatgtatgtacttactagatggaacacgcactctgctcccasatgacaagtgggactaaggatggtatggtgacccacacgtcggcgggaacgggtggagaggaagtttatcgtgggtgagggtggggtcagaaggatggggacgcggatagatttgtcatctagtacgttggaaaaagtcaccgcgtcatgtgcatgtgcaggctgcaatctcccaccctcaccctggcctgtctacaactggcagtgcatccggcgggcgcgggcgggtcaccgtcacagcaaatccttttccaagcaataccacgttcatcttttaccttttgtaacgtacgcatgttacttttgagctttgacgaattccgtggatcggatttgtcatgcttccatggctcataagtgctctcttttctcatcgaatttacacctatatatacgaaatctgtacacgggagcaggagggcggtccaaatcaaataaaaaagggttcaaaagtcaaaacccgacacccatccatcaacctgcaagctcggcaagtacttcccatgccaccgtcatgaaggaaatcaaccgattaataacctgagtaaattaaccgacacctgcacgcggtccgtaccctaaaccctctcatccgggcccactccccatggacccaccttatatgaagcaaaccacaaggtaaacagagatcaattgctttaattaaccaaccgtgtgttgaggcaggcgacagcggggatgaaaaagtcatcctagaagcatcgcatctcgtgtccgcgtcgttctgcgctccgcctcattctttctaccttcgtctctctctgtgaccacctccacccctcctcttcttcttcctccccttctcccccgatctgcggcggggttgattcgatttcgatccccttctccatccgtcgcccacctccccgcccaggcagccaacgcaatccgctccccgaggcgcctccctgaccctgactcccctgcccccacaacgtgcgtgctcactcgcggtcgggcgggcggggccggcacactcaccgtcaccacacttattaattcctcttccgcgtccgcgcttcaaaaacctcctccggctcgtccccctctaaccagtccccagtcccgcggcggccgcattgcccgccgccgcaccgtgtccggctaggactaggacccctgtttgggctcttgcgtttcgattcctgggtcgtctgcaaggagtgtggccgacggagggggccaaa

SEQ ID NO: 14120 - DNA, 51 bp, Zea mays
ttagcttccatatatacggtgcttctgttactatagtatacgaaataaaat

SEQ ID NO: 14121 - DNA, 875 bp, Zea mays
caagtgcgcgagattgatgtgtgagtgatcaagagtgctcaaagaatgcttggatatcttctccatgcgcctaggggtcccttttatagcctcaaggcagctaggagccgttgagagcacatctggaaggctatccttgccttctgtcgtcgggcgcaccggacagtccggtgcacaccggacactgtccggtgcccgatttgtttccataaaaagcgaagccgaccgttgccaaccgttgcagatctggcgcaccggacagtccggtgcacaccggacagtccggtgcttccttccgaccgttggctcggccacgtgtcgcgcgccgatcgcgcggccgaccgttggcccggccgaccgttggctcaccggacagtccggtgcacaccggacagtccggtgaattttagccgaagtcgccggagaaaaacccgagagcggcctcttcggccgaggcagcctggcgcaccggacactgtccggtgcaccaccggacactgtccggtgcaccaccggacagtccggtgccccagaccgaagcagccccttggctgtacacagccaagtcttctcttctcttcttctatctgtttctaacacttagacaaatatattagtacacaaaaccaatgtactaaggcttagaaacataccttaacttgtgatttgcactttgatcatccttaggcatattttcacatttaagcacttgtgtttgcactcaatcaccaaaatacttagaaatggcccaaaggcacatttccctttcaccgagtacattgccgcaggacattgttgcgcgtaactactttggatgaggcaaacccttagggactatggttacaaattaaccaaagttcctcttctatgtgata

SEQ ID NO: 14122 - DNA, 1009 bp, Zea mays
tatcagcatcaccaaaaaaagtagagtattacgcaactctacgcaacccgaacctatataagtatgtgtgtcattccgtcgtgttataacacgaaccatcgatttgcgatcaacggcgtcgtcctgcccaaaagcaccgcgcgggtatccacttagtgcgcggtcggatcacaaacaccgatagtgtaggcatgggagggtgtggacgttgacactacactcttaatagagtagtatagatatagatttagcttcatcaaatacgcacacatcaggtaatgtacatcggcagtttcgtccggagactacctttgttattagtcttgcaacatatgaaataaggtaaaaaaaacaattattaaattagtgttttgagtacattcaacagatactcgagggtggtgcttaaattatccgaaataaattcagactttataagttgcaaccgaaaatctctgaataacatttagacttcgagtattccagatttaagttcgaatatttcagattcgaatatcaggttatatgttttttttggtccagccctactcaccggtagcacgacccggacgcggttccagacttccagttcgttcccgaacactcggagcagaggagcccgggcgctccccgccccgccacgcgactcaacgaatggagcgactccgcgtggtccgaggccattcaggccgtcggatggacgtgacggacggccgcggacggcccagcacagagaaccccgcgattggctcgggcgtccacgcgtcgtgctgttactggtccagatcagactcgtgacgtatcggccaacgcgacgggcgcagcgagatctcgaggcacccgggtttaaaagccgtccctccgtctccgtctctccatcagacagacgcagactctctcacccgactcgtcagacgtcagccagcagttcgaaaccaaggattgatccaggagcttccggaaggcgaggcgcgcgcgcagcgtcgaggtgctggtgccggtgccgccc

SEQ ID NO: 14123 - DNA, 178 bp, Zea mays
agaagaagatgatgggggggggggggggggggaatagtgcccattttgggtcggccgtcgaggtctcccgccggcagccggccggggcagtggccattatgatgatgatgacggggggtggctgctatgtatgtaaatctatccagacatcgtagggatgttctaatccgtaatataa

SEQ ID NO: 14124 - DNA, 758 bp, Zea mays
ctctaaaattaatagttagcggctaaagttagcagaggtttagaacaggtcagctaacagagcaactaattattaactatacctctcaaatagctattagttattagttggcttaacctagctaataacttgttagctcctagcaattagctctaaagttttgtaacggggccttagctaataacttgttagctcctagcaattagctctaaagttttgtaacggggcctaaggtactgttcaaatcttttaaaactaatagttagcaactaaaattaactgagtggtttagaacagaaaccaactaattgtctctcaaatagttattagttatctcatcctacataataacttattagtcggctaacataacaattagcttagaattttggaacggggtcttagtctacttgcgtagatgattaaacttttattttctattgtgaatctctctgacccttcatttttagtttctcttttcttgcacgaatactcataaatgtctctgataatttccattcgctactaggtcttagcaacaagtgatcttgcaataagagtcctgtgtcagagagcctggcctatcctatatattaaccatcaaatggcaagtactccgaattacaaaggaaatattctcataccgtctcagatcgaggtttaacaaactgatcagtgcgctattcctagttcgcgtcctttgccatggcaaaccaagtgcagcaggtgttcatgcgtgagatgacgtctccacgagc

SEQ ID NO: 14125 - DNA, 1500 bp, Zea mays
atcttaaaatatctttactacacgcaatgtgactcacctaatgatgtctatttgatatcataaatattaatgttttttcatatacttaatcaaatatagaattcgtcgactcggagtgcaagatatacacctattttaggacggataaagtatctaatgagaaatttatagctctactctacatataaataaatcacattctacaatttgtctctaggtgaagttttaattgctacgggtggccaatgtacatgttgttgatcaattcttgtgcaaaagaaatcctaatttctaaacacatgttaaatggactggtatgatccgctacttatgcaaacaaccccacgtttgcacagaggtagtccctccctatcgagcatcttgttagagttgtgaaacaaattttgcaaggcctaacaaatatgaatgtattgccttccatgtctcactcctcgtttcctcagtttatcatgttctagatatgcttatatctgatctaaatgatatttttttcatctgcctctttcaagttgtggcttaggttgcctctagagaagtccaaggctacagattgacgatcttggtaaaataaagaacaatcatcactactcatgttaccatgtgattcagatacattaacctttctttagtgtctttataactattgttcagctttgtatacggtagtccttatagggcgcccgtaagggcgcctcatgttctagttttcttcaatccgaagacgaaaggttttgaggatgttgggtaatacaggaccccaatagtgtatttggatctgtcaaatccctattgcataaagggaaaactctcctttcatgtgaagtctcgcagtcctgtctatcgaagccaatacgtaagcattcagcttggatatcctgtctgcttttcgatggccagatcaaaatctgacgttagaaaaaaacaagacgacatgcatcaattgcaggctagaggttcccccaaagattcgttttgagaagatcacgtttttctggttgttgtttcagtaggactccagtgagaggaaaaccacatagggctagtaaggaaactcaaatctatagtttatttttatctctaatcctctctaatatcaaagagaattcgaggttcccaaagtagcctgtttttttggcaacataaaaaaactataagtattaaacaactttcagtattaggtaatgctcttccatctactttttggtcgcttaacacggcatgtatcctgcagtgagcgacaggcctttgtgtgcatcacctgctttatccttattgctttgtggaaaagaaacattgcagtgtaggtgcaccagctgctaatgtggatctctcaccccacaccaagactagcaaccactcctcttaccagcaaagaaataatattgtgatccctgaccacggaaccacacccccagagaaaccattctacatattctcatatacactcattagcacatagcgctaggcgccataccaacc

SEQ ID NO: 14126 - DNA, 102 bp, Zea mays
ttttgcagtaagttatccccacttgtacttaattagattataacgacttcttctcaacaatcattctaatatgtttgtctatacttctagtggaccgaatgg

SEQ ID NO: 14127 - DNA, 175 bp, Zea mays
gcgaagaaaaatatcgcgtgtacgcatgttctatagcggatccgtgcgcacctgtcgtctagttgagcgaacgagggggagcagacttgtgcccctgtcctgaatttgggtgctaatttgtttgtgctgattttcaggggtcgactgaactgagcaggcagtaggaagagacact

SEQ ID NO: 14128 - DNA, 505 bp, Zea mays
tggaataaattatagggactaaacattagttcctagaaaccaaacaccccattaactatgacaaagaatgaaagaaaatgttgtgtattgtctcgacttgaaaacgaaaggctcccgcgcgtacgtccgcttgttttcattcctagtagtagtggcagtgggtggtggagccgtcgtgatatggacggacagcgacgcggcaacgggagttttaaaagcgccctcccccgctccccgcgtgactactctcctattgagcaaggagtatatagcgcaagttaattaaagctgagtaggaggaaggaattcagagtgacctgttccaccaggcgtccaagcaacccggccggctgggtggctcgtcgtcgtagaactccttggtggccgggcgcgcggcgaacgatcgcctatttcagctgctgagcgggcggctgatcggcggcgttccacggcttgggttacctaccactaccaacgacggaacggaaccggccgggccggcggc

SEQ ID NO: 14129 - DNA, 491 bp, Zea mays
tagtggccactgggcatcgtaactacgtaaaaaagtatattatgttatgtatttttcatcatgttttgttgtaaaatttgtgtctaggggtaatttattatcagatcttgtaatctatccaaaataatgataaaacattcataacgtattttttaacatatgttatgtccattaccaccccccgcaaaatttatttgaagcacatgcgattgatggccatatccttatgttgacactgttctcaagatcaataaacctgggctgtggttgtgcttgtgctgacctttagtcctgtgcagtgtagtaatcactaatgtatttttttatttccatttgctgacacctgacatcttatttccatgaagagttgtaaaaagaaatgcttttgtaccatcattgctatttcacgatgtcagtatgtattgtactgaatgtttacatttttttggttataatcgttttgcagcatacagaaagatccggctcagagg

SEQ ID NO: 14130 - DNA, 505 bp, Zea mays
ttcagtgctctgaagcctaagatgatgcttaaatcttggttttcgacattttggctctagctggtagctgctacacttaatccttaatgtagtgatgacaatgtagttctagttaggagaggcatgtactattgcgacattttgacactagctggtagctgctacaacattttggctgctagctggtagctggtagctagttctattgtgacatgtacgcagtatagtacttagcatttagcaatgctgatggctcacgctcatgactgcttgcctatttacttagctttatctgtctattagcctgatcggttgtgacatttgaatctggatgctatatatgaatgaatgatgtgtctttatatccgaagaaaatattcgtaaccgaagatattcgcatccgattcgttccgtattcgatatgtgacaatctgtatccgtaaccgagacaatccgtattcgtattcgtatccgaagatattcgaattcgaatccgaataaaaaa

SEQ ID NO: 14131 - DNA, 729 bp, Zea mays
gatgccactggtctttagatgttagtataggttaaaagtagtataatgaaataatgtagtagtatttagtagtgtagagtagtaaagtgtagcgtagtagtagcagtagggaagtatcaactcataatgagttgatttgtaagtattgtaacttcccttaatgaagaatgatttcgtctcctctttatagtcaattgatctctgktgtgatatttattgttcgtaatgctctctgtctgttatgcttgtgtcgtaacttggagttttcgaatcattcctccgtttgccttatctgtgaagtcaattcctctggaatagtagctgagtaactcgggcatcatatcgtcgcttttaggggtgatggccaagttattattgtcaacatttatgcttctgaagtagcgtccaaatgatgacgaagccacatcagcgatggaatgactgatgaccatgtcggcgcttttagaggtaacagccgagtgacttatgacgacgtcggcgttttagagataactgccgagtgactgaagacgacgtcggtgttttagagataactgtcgagtgaatgatggtaacgtcggtgttttaaaaataacagccgagttggaacgggctgtgtcggccactttgaaggtaatagccgagtgatgatgtggcacaccggtgttttagaagtaaccgtcgggtgatgacatggcacgccggtgttttagaagtaaccgcagggtg

SEQ ID NO: 14132 - DNA, 228 bp, Zea mays
caacggtccatattggctgcgctgcgacggctgcaagtgggcctaggcccagtaacgtgtgtgactgggatgggccacggcccacagaccggcagatccggacgcccccaaggccctcccaaccctaccattcctttctctccctctcgccgtcgtcgccacctccacttggccccgctcatcgcctcctccgacgaccaccgtccaccggcgacaaggacagcgacg

SEQ ID NO: 14133 - DNA, 829 bp, Zea mays
actaggtcacttacttgggagaaaggtcagaaaacttcagataacaaattgtcttgtcaacaaaattctcagtcggcatcaagtaggcaacataaaaaaaatcgagcagttgtacctagcggcaccagcgagataggctgtgttggggtatttttgtaaggagctgttgaagttggatatacttttgagcttttagacttttaggaggagcccaatatatagatattgrgagaaaaataatatgagcagttrgagatgctctaaaagctcatatgctttagatcgctctagtagattatctaaagtttactcatatacactattctatactacattctataatattcatagaatatagtttgaatataattatgaggatgaattaactgttggagatatgcagataggcttatagaaaagaaaacattttgacactctcatcgaaagggaaatgaaacggctgggctgcccgtctcctcctacccttaggcccaacttgaccggctagaatctgggctgactcggaggaaagaaacacggatgcaatccgcaatccagctgcgggtgacggccccgggccggatgacgagcgagtcagggaaggaacccaccccgccgtctttctgattctgctgcccccatccccccatatcccttcgacccttccgccgagctcggcctcgggcggcgtcccggtctcaccgcgaccgggcggtgagaggtagaacggccaccagacatcaaccgtgaaggggtggcgtcaaggcagcgctgaagcggcggcgacgtcgaggctcgagctcccgtgccgcgttccgagctaacctag

SEQ ID NO: 14134 - DNA, 473 bp, Zea mays
atttaccttcctgctcggttattttagtgtgttgtttgccttatagagtaaaacttcccagttccttatttctccattatgttttgtttaatttgtcttaattatgctgtgtactgaacaaacttacacaagagaaattcgatcttttaaagggtcaactaatggaagctggagaatcggtaaatagtagtttttagagtcttctaagatttaataggcaactctaatattaagaatagtagttttaagagttttagttgtcttacagttaaaaatgtcagagagttaaaagttgattctaatgtgatagttttttagagttcgacaaactgaaactatratagctttttagactaaaagtgtgatagctttttagttagtcttttagagcgaggcaacctttcagacatcggccactttatttttagttgattgactggcatgagggtggatacttgactgttgatttacca

SEQ ID NO: 14135 - DNA, 234 bp, Zea mays
aaaggttagaaaatattttatttagctgatctcgtttgagacggtctgaattcgcatcacaagtccggcattggcgcgcgcactaataaagctagaaaaaagaggcgggaaagagtgaaaatttggcgccattccaggaatcgcgaaaagaaaaggtcctacctcgtatcgcgtccaattgctttgctcattctcgtgctcggcaggggaacggtgcgaagcggaggagcggcg

SEQ ID NO: 14136 - DNA, 500 bp, Zea mays
cctataaggattgcagttttcatttgacatgagaaaactgaatggagatgatgattaaagataaagtgacaaaataaataaataatgtaattggagtatatgacaattgtagttgttcaaggaatatatttacagttagatatataatatcaactgaatagcacatgtagaatactgaaacctcatataattataaggagttgttcaacctcatttttttctcgaaaaaacgcaggaggactgcgttttagatatatattaagaagagagagacaaaggtctaagagaccaaaaaaacaacaacaacgcactccctatggaggccagtaacactcgtacatgaaaggatccataaaaacacccacacacactccttacaacaacctatgcagggggcagccaagaaggagagccctttggctccagcaatttcccagcctcttctttcctcatctgcatgctccataatcaaaggaaggctgggagaccctccataaaaa

SEQ ID NO: 14137 - DNA, 791 bp, Zea mays
ctgatgcacgtgggtcctcgtccacacgcctctttcttctctatagcaaatcctatagtctacaagcttatcaagagagtccatgaattaatcattcgttgcaacgattatcaaacgttcgatataataaattagcatatcttaacgactgccatgcacttattcttggaaaaataaagtcatcccatgtgtccttaaattgtttacaggctcgaaattttatatagagtagtggtctagtggagtggagtcatattcaagggccaaaccgtccaaacgcacactgtattctttgatctgaccagaaaatcgcggcgagggtggtggtgacaaaagcgtgacagccacgagtgggcccggtgttgggctcccgcttcccacgtcacgggcgcataaactaagcccacgggccacgtccacggagcgccaccgcccatgtcctgctccaccgcccagattcaggcaggccggtgcaggtgcggtgcagtgcagtgccatgccagctctatccacgccgtccacgtacccgcccggctcgacacgcgcggggttttttttttccgctccggctccagctccagccccagcctccagcgcaggcgcgccactttgggaagccactggccttattaatagcaaagattagctgtggcagctcgtcattgaactgctctgggaccgccctgtaacatccaccaactcgaggaggaggaggaggaggaggagaagaagagatccccccacctagcctcggtttccaagcgccagcagaagaagaagagacaggacac

SEQ ID NO: 14138 - DNA, 777 bp, Zea mays
agtttcgaatactccaaaaagaccatggtatctagaataccatggttttgaaaacatagtttttaggaatgcaaccaaacactttatgacataaaatactctggtattcctataaaccattggtgttgcctagaaactataaaaatacttccaaacaggcccgatatttccctcaaacttataataagccaacttattggagctaacacctataagctagcacctatgagacagcttatatagctggtcagggacacaaacaagcccaaagtctagtgaacgtgtagttcatatccaactgttcgtccaatacttttctgtccaattcaaactgtcagtgttattaaataagatggctaatcatgaatagtcatgattagtttgccttattggtccgtggaacttgattaagcacttcaatacaattagatcgactagaaacctatttgtcccactaaccatgatttcagttgtctgattagtaacctgtggacgactaactggaaggcccaaaggtgaggaaaagatgtctgggctctcgcctaaacagttgtgctaagtaatttggcccatcagcatcaggttttcagtatgaacggtttctggactggattcttgactccatgcccatactgccccatgtccgccttgtcgagcccatgccgctgactattgttctcatgtgactggctggctcctgtcctcacgctgccagtggttctcgtcctagcaccaaccgcatcagctctcaccagatccgttcatcatttcatcccc

SEQ ID NO: 14139 - DNA, 471 bp, Zea mays
agtaatttattacctgtaccttgcacgttctttctattccctatccagaaaaaggagggaattactatctactaccccctctgtttcaaaaggccactttggctttgttcgtcaaacgtctttgacgttgatgaaatattaaaaaatatattaacatctacaagtccaaataaatacacaataacattttcattgataattttataaaatggaatcaatttgatgttggagcatttttctacaaaccttgtcaaagctagagaagtttgacctatgacattgctaaagtgatctataatttggaatggaggatgtctttagtttgatctttattttatgcttgaataaaatcatggctagactcttgtagttagtaattcattatattgttctcttatttcaggtttgttctttctgcagatcgaacctatccgcaacttattcgctgctcttttccttgccagcattggg

SEQ ID NO: 14140 - DNA, 1500 bp, Zea mays
tcccttttagtcaccctttgagagactaaagactaaaatagtttagtccttgttttagtattatcgtttgacaatttaggaactaaatgagactaaaatgaatgaactaatttttagtctctcaaaccaaacagggcctaatctttagtccctcaaaataaattgggccttatagatgttaatgtttttttttgaaaaacttagttaaagataggaatttagctkgtaggatcgatccaagcagctattaattgccagataccatagttagttatgctattagagcatttctaggagttttagatcgtgtccagcagtttacttatatgattaaccaaaatactttgaatatagggataagaataggtaagctgtagtcttataaaacaatttgataattagtttttttcctgaaataagagcttcttatgggttagtttggaaaccccattttaccaataaattttcatgtttccaagaaaatatagttcatttttccttagaaaaataggaatccatcgagaaaattaacttcctaaactagccctaagaagttagattatcttttccaacttctaagttttcgcaatcaagaaacttcgtatcagctctatgtcatgcatttttcttaggaaataggagtaaattggacgcatgagtcaattaagaaaataaagaatttcagataaaaagcggtaaacaacttaaaaaataaatagttctagatgataaagcagtaaaaagaaaaaggattagtaaaaaatatgattagtaagaaatagtttcgagttctgataaaaaatgtttaaggctaatttggcaacccattttcttaagggatttatatttttctaagagaaattagttcattttttcttaaaaaatggagttgtcaaactagttcttagaaaattattattataaattgttggagaatgataaaaaattcaaggttgatacgtcttctaatatttgctagatctattagtttagcaagtaaactatgtcaagttttcttaagatgtgagctccaaagtgccctattttaaaatataaggcttaaccaatggtgtagctaatgggtggtctatggcataccctaggccggctcatcggatcatcagtccatcgaggccgaaaaaagtttaacactaacagtgtattttgtgtttaatatttagacatttttatattatatttgcgatctaatgtatgcacttacaaacttagagtctgtttgagaacttcgttttgtaaattaaatttggttattattagaaaaaacgactaataaattatgtaaataactctttaaatttagtagctctacattctttcacattcactctatttttatatagccagtcttttggtgtacagagtatgttagattaacctaattttactcttggattaatctaattttttgtaaagtctattgtagagagtagctatatttgctctaagttagtactttttcagaaactgtagaccggagca

SEQ ID NO: 14141 - DNA, 1500 bp, Zea mays
atcatcctaaaatgtgaataaccgaacaaggtctaaaacacatgtctatttgttgctggacgtgggtggaggcgcatgcataaaaccaagagcagcattgcgtacatacgggtctgtttggttgggctgtggctgtgaaaaaaagctaatgtgggttgtgagctgtcgaaaaaaaattaatgtgggttattagctgtgaaaaaattgttgtaggttgtgaactgataaaaaactaaaaactgtttggtgaaaaccactaaaagccgctaagaattctttcatgtatattttcgccaattccattcaaaagtcacaaaaaacatattcataagtgctttcaagtgctttcaattttacactgcgaaaaagtcgatatttagaaaaaaaaaactattttctagattcaaccctttgatttggcttttagcgtaaaagttaaatccaaaagccaaaccatgatccaatacaacatccgctggcccatgtccctttcaattttttaggaaaaagtttttagtaatttctgtgagataacatatttacagtggattttattttctaagggcgctaccgcgctaataagagattttgggaaacaaatttttagtgcttttttggagctgctctaaaacctcttttagggaaaaagagctagtatattctctccgtaaactgtcgatactttcttaattttttcgcatcccctgtatcggcatcctctcacccgcatatttgcgtgaaggattccccaatcctctatatagcttacgtcaactgacggcaacaattagtattttaaacttttgttacagggtcacggtcgtaatctggcggcctgcaggcacatgcaaggcaagtgtcgagtgtcctgatgctttttcgcgtgtggaaccaaattgtaaactggactgcttcctaagatttctacatgcgactttagctgatatgcagggtcgtcagctttttttagctttctaccaaaaaattcagcaccattgtagagcaataactatacttgtgttcagctttgcacatggtacttccattgtgctcatcttttttactgaacctgactgcttgcttccagatttcagcaattgtgttcagatgaaataccggtgcgtaagtacgtggcccaatatattatccattggcccatattcctttttaaattttttagataagtttttagcaatctactgtgtgataaaaaaaactatgaatttttttccaacagtccctaataaaatattttgggaagaattttttagggaatttttggagttgccgtaagtccctgatcatttccacgaaggcttttctcaccggaaaaagatcggaattccggcgggaatataggccgccaaagtaggacctcgcaaaaggcggctaccaaaacgctccgttgcctttcctttccccacttccccggctcctgcctcccgccgccgacaccaccaaaaaccctagcagctccaccccgccgccgccgccgccgcc

SEQ ID NO: 14142 - DNA, 96 bp, Zea mays
ggtcatccatttatgaaagcagccgtatttgttccttccccacagtatcacagatctttattatgtctgtttctttatatgtgctgcagtgttgtc

SEQ ID NO: 14143 - DNA, 101 bp, Zea mays
tgtaagggctgtgtacctctgcttgattttaatatttgactaaactgaccaggatatcttggcctattctatttttaattctggttcttttacatctttgt

SEQ ID NO: 14144 - DNA, 1269 bp, Zea mays
ctgcagcagcgacatttgcttagcgtgcatgcaatccaaggcacaatcaatcatggcgcattttcttccccgcaaaaataaatattttttaatttttattttattttttggcgccgagatactttgcgtccggaccgatctgtgcgtatctcagctcagcagccagcaatgatcgtgctcttgattcttttccctccatctttcttaatgcccccacttggtcgcacggccgggcgggcctctgcgatgccatgtgttgtttatttgtttgttcgagaagaagctagagtgctgtgatgtatgtggcgggcctcaaaatggaattcaggaacaggagaaggaaaaaataaaaactggacaggtagtgaagcaaagcagaggtgagagacgacgatccgcaccattttccggcctggagtcaaaagagaacaacagatcttccagtttttttttaaaaaaaaagaaggaacaagctttcggttttcagtgaaaaaaaaggggaaaatcagaggactccatgcacaaagacactactactattggccgttcgcgtagtgactagtgacccactaagtctaacggcaccttggaggtagtgattgggcgttattttctgctgctcctgttgccggatcatgcgtttgtacacgaccaatatagattatagatccatgaagaaacgatcattgcaacaatgattctgaaaatctttgcatccatctctgaaaaaaaagcagcagtgcctggagtggagtggagtggagtggaagggatagccaactatctgtatatatcgctcaaattgaatttttagtcgtataattaaccacccatcagcgttccactcgcgtagaagtaacagcgctcgcagctcggtccgggtacgtcgccaatgccgttgcgtggcggattcactctctctctccccccggccccctcctccgcccatccaaccaccatataacaacctagtagccgccaacgccacaccaccagtagtcctactggtccttgacgtccgtggccactcaggttgtgttctctgagttctttcgccggggccggggcggaagcggagtgcgcggtcgaggaaggcctaggccttagcggtcggatcgatcggcgccgtgcttgactgcctgtacatgaggagcggctgcggcggcggcggcggagggagacaacctggggaaggaggcgggggaggcgctggggctgctgggctgcgtcaatgaggtggtggcggcggtggcggccacgtgggggccc

SEQ ID NO: 14145 - DNA, 1500 bp, Zea mays
gttatcggtatttggaggcatatgaggttgaccgtagtcttcaaaaatttgagcaaaagatattggaaaatacaactgaagagattgcttcaaaaatcagagcaattgctcgatggagagaaagtttagttgtaagtactgtcgttttatacttctgcagttctgctttattacgcatgtctaattgttatgttttattttgccaactcatcaacttgcaattttcccccttcatagtgtaataaaaaatgatacacttgatatttttttctcgaaaagagcgcaggaggactgcacacccatatattaaagtagaggggaaaaaagggccgtaaagacccaggtacaaagcactccttatggaagccagaaacagacatacacaaagctatccataaaaaattggactaagcaactgcaaccctaggagctaggaagtttggccggccaaaaaggaaagccccttggcaccagccagctgccacatctcctgttcatcaccagcagcctgaagaaggaaggagatagaaggggtccttccatctgttaagacccataaggcccatatattattgtctgcctatatatatgctacagtacccgagggggctattatctcgcctaatccaaggttagtcacatggtaacagagcaggttagggttagggtttacgtctaaacccaaccctgatccaatttttcggcgccgtcgctgtgctgcccttgcgcttgcggccagctccttcctctgctccggctgttgtcgctgccctcccactcccgcccgccgtcgcggccgcgggccccttttcccggccgccgtcgcggcctgctggccgccgcttcgtcggggatccaccgtccctgcgcatccgccgtccgccgcgccgtcgacctgcgcatccgctgtccgcccgcttcgtcgcggatccgccgttcctgcgcatccgccgtctgccacgccccgtccacctgctgtccctgcgccaatcgcagattcgcgcagatccgcccgccgtcgcagctgccgcgccagcgccagcgccagcgccacgccgcctggatccggcgagcgcgtggccgggagcctcagatccgagcgaaacccagccttcccgtggtgacggccttcgctctagctccagattggctggcgggtgccattcctcctcctcctcttctcgctcgaggttccaaggcgggtccgttcagctctggtgggttttcgggtttgctcatactttttcttcggttggtttgcttcagcgtggtccagatttagctgcattttctcgggctgtgtttttctgtgccagaaatctacggaggagtcttgccgccgcgctttaaacgtagaggtagagctgtagtatatattttggcgagtaatcctgcttcttgctccgttcccgtgctagtgctggcgtgagacgcgtgacagtggaaaggcttactgttgccatggtattggtgtgacgacccgtcaaggttttgcgcaag

SEQ ID NO: 14146 - DNA, 709 bp, Zea mays
ataatgtatttataatatgttcgattagccaaaggtaatacacatttttttactgacttttcctagtattgatagtaattagtagggttcttgtaatctgcattcattatttgtgtcagcatttcgtagggagaaatatgatagtggttcatagtttcgtagtgtcattgtatgccgttgtctcagaaaggtttcagactagcatgaagcatttgaggcacgtgacggtcttactgatgccgttgtctctcagaaaggcttcctcttctctgcagatgttcattgttcagttaattctatatgcgtcggtgcattcttactcgagttacaagtacactaggaacacctgtcaggtagccaattctgtaatattctccaacatgaactgcagtgcagatcatatgtaatcatcgatcatatgcaatcgctctttgtagctgttaacctgtagcctctgatcgttgttgctgagtcgtctttctcttccccttggcatgtccgtaccaaaaaataagttatgaaaccacgaagtcgcgcccaccaacggacgctgcctctaaaaaagcagatcagcgcgttgtcgcagcgtcggagcacaagcgacatcgctccccgggggccgtcggccggcgaccggcgacttccgcagtagaaccaactccacccacccatccacttggccagcagcttcttgcctgcatcaattgcc

SEQ ID NO: 14147 - DNA, 966 bp, Zea mays
gattatggttgttagtgacgctcagtcatgtgtatttcgctggagtcatgttgactatgaacttatgaagtcatggctatgattacgattttttgtatgcgactatgactatgaagtcagttttttgtgccacagaaagctcaatgactatgaagtcagttttccgtcgtctgtcttgtctctattacttttacaagccgtgaattgtcttggcagtgtgattgactgattgagaatttaaattgaactcttgctgttttttaaagccatgtcctgttttcagtgttttgtaatgtatagctcgcgagtcaaacgagctggctcgagctacaaaacgagtcgagccgaatgtgattcctagctcgctattttaacgagccgagccgagctagctcgttttattaccgagccataacgagccgagctggctcgatatccacccctaccttgtccgcccgatccgatgtgtgtccaccgtccagcggcctcccccaaaaccccagacagaagcaacgctccaccactccgccacgtcaggtgcttccggctccactcggagagactgacaccctatccgattcgtcgaatccgccattaattactccccagtccccacccacccacccttccctactcctaccaagcgcatgccacaatgcccagactataaaaatcgaagcccacgccgggagctccatccctaaaaaaaaacaaaagccttcgcttcgcttcaccactctatcgctccacggccggccacaggtactgggtcacagagatgccatgctgatgcttccattccattccattccttctctttggctggctctgctcttgcattaatgcatgtgttcctctcgtcgtcctcgaccaatgtgctgttctgttgtgtttgttggtggtagctagctgcgtgctgtcctgggggagcagcagcagcttcggcgggaggggaaaggagctacg

SEQ ID NO: 14148 - DNA, 48 bp, Zea mays
tgaggactaacttgaaggtggtcgataactctgggggccaagtgagtg

SEQ ID NO: 14149 - DNA, 196 bp, Zea mays
aggtgtgtcgcagagccaagagccaagtgtttatgggaatgtttttttgtctgtgttctctgtttgaataatgcattgtgaaacgatagcatggaccgtttgaactattttgatgatattgctcgcccatttggatggccaatacgtgttgtgatctattctggagtttcattttttggttacaagctgctttcac

SEQ ID NO: 14150 - DNA, 48 bp, Zea mays; identical to SEQ ID NO: 14148

SEQ ID NO: 14151 - DNA, 137 bp, Zea mays
atagctaagcgaagcaaattcaccgaagagggggcacaagggatgcaaggcttggcgatccactgattcggggcagatcagctggttcgtgaattgagattatagcgtgggagattagaagggcaacctttttttgt
